(12) United States Patent
Klippel et al.

(10) Patent No.: US 11,787,859 B2
(45) Date of Patent: Oct. 17, 2023

(54) TIM-3 ANTAGONISTS FOR THE TREATMENT AND DIAGNOSIS OF CANCERS

(71) Applicant: Bristol-Myers Squibb Company, Princeton, NJ (US)

(72) Inventors: Anke Klippel, Princeton, NJ (US); Laurence Celine Menard, Princeton, NJ (US)

(73) Assignee: Bristol-Myers Squibb Company, Princeton, NJ (US)

(*) Notice: Subject to any disclaimer, the term of this patent is extended or adjusted under 35 U.S.C. 154(b) by 153 days.

(21) Appl. No.: 16/642,511

(22) PCT Filed: Aug. 28, 2018

(86) PCT No.: PCT/US2018/048375
§ 371 (c)(1),
(2) Date: Feb. 27, 2020

(87) PCT Pub. No.: WO2019/046321
PCT Pub. Date: Mar. 7, 2019

(65) Prior Publication Data
US 2021/0171629 A1 Jun. 10, 2021

Related U.S. Application Data

(60) Provisional application No. 62/551,137, filed on Aug. 28, 2017.

(51) Int. Cl.
*A61K 35/17* (2015.01)
*C07K 16/28* (2006.01)
*G01N 33/50* (2006.01)
*G01N 33/68* (2006.01)
*A61K 39/00* (2006.01)

(52) U.S. Cl.
CPC ....... *C07K 16/2803* (2013.01); *G01N 33/505* (2013.01); *G01N 33/68* (2013.01); *A61K 2039/507* (2013.01); *G01N 2800/52* (2013.01)

(58) Field of Classification Search
CPC .................................................. C07K 16/2803
USPC ..................................................... 424/133.1
See application file for complete search history.

(56) References Cited

U.S. PATENT DOCUMENTS

| | | | |
|---|---|---|---|
| 6,808,710 | B1 | 10/2004 | Wood et al. |
| 7,488,802 | B2 | 2/2009 | Collins et al. |
| 7,943,743 | B2 | 5/2011 | Korman et al. |
| 8,008,449 | B2 | 8/2011 | Korman et al. |
| 8,168,757 | B2 | 5/2012 | Finnefrock et al. |
| 8,217,149 | B2 | 7/2012 | Irving et al. |
| 8,354,509 | B2 | 1/2013 | Carven et al. |
| 8,609,089 | B2 | 12/2013 | Langermann et al. |
| 8,779,105 | B2 | 7/2014 | Korman et al. |
| 8,779,108 | B2 | 7/2014 | Queva et al. |
| 8,900,587 | B2 | 12/2014 | Carven et al. |
| 2012/0189617 | A1 | 7/2012 | Takayanagi et al. |
| 2013/0017199 | A1 | 1/2013 | Langermann |
| 2014/0341917 | A1 | 11/2014 | Nastri et al. |
| 2014/0356353 | A1 | 12/2014 | Queva et al. |
| 2015/0079109 | A1 | 3/2015 | Li et al. |
| 2015/0218274 | A1* | 8/2015 | Sabatos-Peyton ........................... A61K 39/39558 435/254.2 |
| 2017/0029485 | A1 | 2/2017 | Han et al. |

FOREIGN PATENT DOCUMENTS

| | | | |
|---|---|---|---|
| WO | WO-2011155607 | A1 | 12/2011 |
| WO | WO-2011159877 | A2 | 12/2011 |
| WO | WO-2012145493 | A1 | 10/2012 |
| WO | WO-2013006490 | A2 | 1/2013 |
| WO | WO-2013173223 | A1 | 11/2013 |
| WO | WO-2015109931 | A1 | 7/2015 |
| WO | WO-2015117002 | A1 | 8/2015 |
| WO | WO-2016057705 | A1 | 4/2016 |
| WO | WO-2016068802 | A1 | 5/2016 |
| WO | WO-2016068803 | A1 | 5/2016 |
| WO | WO-2016070051 | A2 | 5/2016 |
| WO | WO-2016071448 | A1 | 5/2016 |
| WO | WO-2016111947 | A2 | 7/2016 |

(Continued)

OTHER PUBLICATIONS

Das et al (Immunol Rev, 2017, 276(1): 97-111).*
Anderson, A. C., "Tim-3: an emerging target in the cancer immunotherapy landscape," *Cancer Immunology Research* 2(5):393-398, American Association for Cancer Research Inc., United States (May 2014).
Bird, R.E., et al., "Single-chain Antigen-binding Proteins," *Science* 242(4877):423-426, Association for the Advancement of Science, United States (Oct. 1988).

(Continued)

*Primary Examiner* — Sean E Aeder
(74) *Attorney, Agent, or Firm* — STERNE, KESSLER, GOLDSTEIN & FOX P.L.L.C.

(57) ABSTRACT

Provided herein are methods for treating a subject afflicted with a cancer, comprising administering to the subject a TIM3 agonist (e.g., an anti-TIM3 antibody), alone or in conjunction with another immune checkpoint inhibitor (e.g., a PD-1 antagonist), wherein the subject is identified as having a high frequency of TIM3 positive cells (e.g., on the tumor infiltrating inflammatory cells) or soluble TIM3 in peripheral blood. Also provided are methods for assessing the efficacy of a treatment comprising a TIM3 antagonist in a subject afflicted with a cancer, comprising measuring the frequency of TIM3 (and optionally PD-1) positive cells in certain populations of cells and/or the soluble TIM3 in peripheral blood of the subject, wherein a high frequency of TIM3 (and optionally PD-1) positive cells and/or the subject's peripheral blood titer of soluble TIM3 is indicative of the response to the treatment.

16 Claims, 8 Drawing Sheets
Specification includes a Sequence Listing.

(56) References Cited

FOREIGN PATENT DOCUMENTS

| | | |
|---|---|---|
| WO | WO-2016144803 A2 | 9/2016 |
| WO | WO-2016161270 A1 | 10/2016 |
| WO | WO-2017019897 A1 | 2/2017 |
| WO | WO-2017031242 A1 | 2/2017 |
| WO | WO-2017055399 A1 | 4/2017 |
| WO | WO-2017055404 A1 | 4/2017 |
| WO | WO-2017079112 A1 | 5/2017 |
| WO | WO-2017079115 A1 | 5/2017 |
| WO | WO-2017079116 A2 | 5/2017 |
| WO | WO-2017178493 A1 | 10/2017 |
| WO | WO-2017205721 A1 | 11/2017 |
| WO | WO-2018013818 A2 | 1/2018 |
| WO | WO-2019046321 A1 | 3/2019 |

OTHER PUBLICATIONS

Brummell, D.A., et al., "Probing the Combining Site of an Anti-Carbohydrate Antibody by Saturation-Mutagenesis: Role of the Heavy-Chain CDR3 Residues," *Biochemistry* 32(4):1180-1187, American Chemical Society, United States (Feb. 1993).

Burks, E.A., et al., "In vitro Scanning Saturation Mutagenesis of an Antibody Binding Pocket," *Proc Natl Acad Sci USA* 94(2):412-417, Plenum Publishing Corporation, United States (Jan. 1997).

Das, M., et al., "Tim-3 and its role in regulating anti-tumor immunity," *Immunological Reviews* 276(1):97-111, Wiley-Blackwell Publishing Ltd., United Kingdom (Mar. 2017).

Du, W., et al., "TIM-3 as a Target for Cancer Immunotherapy and Mechanisms of Action," *International Journal of Molecular Sciences* 18(3):645, MDPI Multidisciplinary Digital Publishing Institute, Switzerland (Mar. 2017).

Edelman, G. M., et al., "The covalent structure of an entire gammaG immunoglobulin molecule," *Proc Natl Acad Sci USA* 63(1):78-85, National Academy of Science, United States (May 1969).

Fourcade, J., et al., "Upregulation of Tim-3 and PD-1 expression is associated with tumor antigen-specific CD8+ T cell dysfunction in melanoma patients," *Journal of Experimental Medicine* 207(10):2175-2186, Rockefeller University Press, United States (Sep. 2010).

Ge, W., et al., "Tim-3 as a diagnostic and prognostic biomarker of osteosarcoma," *Tumor Biology* 39(7):1010428317715643, 8 pages, SAGE Publications Inc., United States (Jul. 2017).

Genbank, "HAVCR2 protein [*Homo sapiens*]," Accession No. AAH20843.1, accessed at https://www.ncbi.nlm.nih.gov/protein/AAH20843 on Mar. 9, 2021, 2 pages.

Genbank, "*Homo sapiens* hepatitis A virus cellular receptor 2, mRNA (cDNA clone IMAGE:4701288), complete cds," Accession No. BC020843.1, accessed at https://www.ncbi.nlm.nih.gov/nuccore/BC020843 on Mar. 9, 2021, 2 pages.

Genbank, "*Homo sapiens* hepatitis A virus cellular receptor 2 (HAVCR2), mRNA," Accession No. NM_032782.5, accessed at https://www.ncbi.nlm.nih.gov/nuccore/NM_032782 on Mar. 9, 2021, 4 pages.

Genbank, "Hepatitis A virus cellular receptor 2 precursor [*Homo sapiens*]," Accession No. NP_116171.3, accessed at https://www.ncbi.nlm.nih.gov/protein/NP_116171 on Mar. 9, 2021, 3 pages.

Genbank, "Programmed cell death 1 ligand 1," Accession No. Q9NZQ7, accessed at https://www.ncbi.nlm.nih.gov/protein/Q9NZQ7 on Sep. 16, 2020, 8 pages.

Genbank, "Human hPD-1 (hPD-1) mRNA, complete cds," Accession No. U64863, accessed at https://www.ncbi.nlm.nih.gov/nuccore/U64863 on Sep. 15, 2020, 3 pages.

Geng, H., et al., "Soluble form of T cell Ig mucin 3 is an inhibitory molecule in T cell-mediated immune response," *Journal of Immunology* 176(3):1411-1420, The American Association of Immunologists, United States (Feb. 2006).

Han, G., et al., "Tim-3: an activation marker and activation limiter of innate immune cells," *Frontiers in Immunology* 4:449, Frontiers Media S.A., Switzerland (Dec. 2013).

Herbst, R.S., et al., "A study of MPDL3280A, an engineered PD-L1 antibody in patients with locally advanced or metastatic tumors," *Journal of Clinical Oncology* 37(15_Suppl): Abstract 3000, American Society of Clinical Oncology, United States (May 2013).

Huston, J.S., et al., "Protein Engineering of Antibody Binding Sites: Recovery of Specific Activity in an Anti-digoxin Single-chain Fv Analogue Produced in *Escherichia coli*," *Proceedings of the National Academy of Sciences USA* 85(16):5879-5883, National Academy of Sciences, United States (Aug. 1988).

International Search Report and Written Opinion for International Application No. PCT/US2018/048375, European Patent Office, Netherlands, dated Jan. 29, 2019, 18 pages.

Jefferis, R., et al., "Human Immunoglobulin Allotypes: Possible Implications for Immunogenicity," *Mabs* 7(4):332-338, Taylor & Francis, United States (Jul.-Aug. 2009).

Kabat, E.A., et al., "Sequences of Proteins of Immunological Interest," 5th Edition, U.S. Department of Public Health and Human Services, Public Health Service, NIH publication No. 91-3242, National Institutes of Health, Maryland (1991).

Khleif, S.N., et al., "MEDI4736, an anti-PD-L1 antibody with modified Fc domain: preclinical evaluation and early clinical results from a phase 1 study in patients with advanced solid tumors," *European Journal of Cancer* 49(Suppl. 2):S161, Abstract 802, 17$^{th}$ European Cancer Conference, Sep. 27-Oct. 1, 2013, Elsevier Inc., Netherlands (Sep.-Oct. 2013).

Kobayashi, H., et al., "Tryptophan H33 Plays an Important Role in Pyrimidine (6-4) Pyrimidone Photoproduct Binding by a High-Affinity Antibody," *Protein Engineering Design and Selection* 12(10):879-884, Oxford University Press, United Kingdom (Oct. 1999).

Lonberg, N., "Human Antibodies From Transgenic Animals," *Nature Biotechnology* 23(9):1117-1125, Nature America Publishing, United States (Sep. 2005).

National Cancer Institute, "Anti-PD-1 fusion protein AMP-224," Cancer.gov, accessed at www.cancer.gov/publications/dictionaries/cancer-drug?cdrid=700595 on Sep. 16, 2020, 1 page.

National Cancer Institute, "Pembrolizumab," Cancer.gov, accessed at www.cancer.gov/drugdictionary?cdrid=695789 on Sep. 16, 2020, 1 page.

Ngiow, S. F., et al., "Anti-TIM3 antibody promotes T cell IFN-γ-mediated antitumor immunity and suppresses established tumors," *Cancer Research* 71(10):3540-3551, American Association for Cancer Research, United States (Mar. 2011).

Sakuishi, K., et al., "Targeting Tim-3 and PD-1 pathways to reverse T cell exhaustion and restore anti-tumor immunity," *Journal of Experimental Medicine* 207(10):2187-2194, Rockefeller University Press, United States (Sep. 2010).

Sharma, P., et al., "Primary, Adaptive, and Acquired Resistance to Cancer Immunotherapy," *Cell* 168(4):707-723, Cell Press, United States (Feb. 2017).

Silva, I. G., et al., "The Tim-3-galectin-9 Secretory Pathway is Involved in the Immune Escape of Human Acute Myeloid Leukemia Cells," *EBioMedicine* 22:44-57, Elsevier BV, Netherlands (Aug. 2017).

Wang, C., et al., "In vitro characterization of the anti-PD-1 antibody nivolumab, BMS-936558, and in vivo toxicology in non-human primates," *Cancer Immunol Res* 2(9):846-56, American Association for Cancer Research Inc., United States (Sep. 2014).

Ward, E.S., et al., "Binding Activities of a Repertoire of Single Immunoglobulin Variable Domains Secreted from *Escherichia Coli*," *Nature* 341(6242):544-546, Nature Publishing Group, United Kingdom (Oct. 1989).

Xu, B., et al., "Circulating and tumor-infiltrating Tim-3 in patients with colorectal cancer," *Oncotarget* 6(24):20592-205603, Impact Journals LLC, United States (Aug. 2015).

Gros, A., et al., "PD-1 identifies the patient-specific CD8+ tumor-reactive repertoire infiltrating human tumors," *JCI* 124(5):2246 (May 2014).

(56) References Cited

OTHER PUBLICATIONS

Baitsch, L., et al., "Exhaustion of tumor-specific CD8+ T cells in metastases from melanoma patients," *Journal of Clinical Investigation* 121(6):2350-2360, The American Society for Clinical Investigation, United States (2011).

* cited by examiner

TIM-3 ANTAGONISTS FOR THE TREATMENT AND DIAGNOSIS OF CANCERS

REFERENCE TO SEQUENCE LISTING SUBMITTED ELECTRONICALLY VIA EFS-WEB

The content of the electronically submitted sequence listing in ASCII text file (Name: 3338.093PC01_SequenceListing_ST25.txt; Size: 717,820 bytes; and Date of Creation: Aug. 24, 2018) filed with the application is herein incorporated by reference in its entirety.

BACKGROUND OF THE DISCLOSURE

T-cell immunoglobulin and mucin-domain containing-3 (TIM3), also known as hepatitis A virus cellular receptor 2 (HAVCR2), is a type-I transmembrane protein that functions as a key regulator of immune responses. TIM3 was initially identified on activated IFN-γ producing T cells (e.g., type 1 helper CD4$^+$ T cells and cytotoxic CD8$^+$ T cells) and shown to induce T cell death or exhaustion after binding to one of its ligands (i.e., phosphatidylserine, galectin-9, HMGB1, CEACAM-1, and ILT4). More recent studies have indicated that TIM3 expression is also important in regulating the activities of many innate immune cells (e.g., macrophages, monocytes, dendritic cells, mast cells, and natural killer cells). See Han G et al., *Front Immunol.* 4: 449 (2013).

Like many inhibitory receptors (e.g., PD-1 and CTLA-4), TIM3 expression has been associated with many types of chronic diseases, including cancer (e.g., melanoma, lung, liver, ovarian, etc.). High TIM3 expression has been detected in tumor infiltrating lymphocytes (TILs) and some tumors from patients with advanced melanoma, non-small cell lung cancer, or follicular B-cell non-Hodgkin lymphoma. And the presence of TIM3$^+$ T cells have been described as an effective indicator of lung cancer progression, with higher expression associated with poor prognosis. See Anderson A C. *Cancer Immunol Res.* 2: 393-8 (2014). Studies have also shown a close relationship between TIM3 and the inhibitory receptor PD-1. For example, many tumor-specific T cells express both PD-1 and TIM3, and these T cells have been shown to be more dysfunctional compared to T cells that express only PD-1 or TIM3. See Fourcade J et al., *J Exp Med.* 207: 2175-2186 (2010).

The recent development of several immune checkpoint pathway inhibitors (e.g., YERVOY and OPDIVO) have begun to provide new immunotherapeutic approaches for treating many types of diseases, including cancer. While such inhibitors have had promising results, a large population of patients do not respond to such treatments. See Sharma P et al., *Cell* 168: 707-723 (2017). Accordingly, there remains a need to tailor treatment regimens to defined subpopulations, and ultimately, to individual patients in order to enhance efficacy and minimize adverse effects.

SUMMARY OF THE DISCLOSURE

Provided herein is an in vitro method for determining whether a subject having a cancer would respond to a treatment with a TIM-3 antagonist, comprising determining a serum titer of soluble TIM-3 in the subject, and if (i) the serum titer of soluble TIM-3 is higher than that in healthy control subjects, or (ii) the serum titer of soluble TIM-3 is at least 2100, 2200, 2300, 2400, or 2500 pg/ml (as determined, e.g., in a method described in the Examples), the subject is likely to respond to a treatment with a TIM-3 antagonist.

Provided herein is an in vitro method for determining whether a subject having a cancer would respond to a treatment with a TIM-3 antagonist, comprising determining a percentage of CD8+ TILs that are TIM-3 positive, and if the percentage is higher than 10%, 20%, 30%, 40%, 50%, 60% or 70%, the subject is likely to respond to a treatment with a TIM-3 antagonist.

Provided herein is an in vitro method for determining whether a subject having a cancer would respond to a treatment with a TIM-3 antagonist, comprising determining a percentage of naïve, central memory (CM), effector memory (EM), and effector TILs that are TIM-3 positive, and if the percentage of EM TILs and/or effector TILs that are positive for TIM-3 is higher than the percentage of naïve TILs and/or CM TILs that are positive for TIM-3, the subject is likely to respond to a treatment with a TIM-3 antagonist.

Provided herein is an in vitro method for determining whether a subject having a cancer would respond to a treatment with a TIM-3 antagonist, comprising determining a percentage of dendritic cells, macrophages, and Natural Killer (NK) cells that are TIM-3 positive in TILs of the subject, and if the percentage is higher than that in control subjects (e.g., corresponding cancer patients who do not respond to treatment with a TIM-3 antagonist), the subject is likely to respond to a treatment with a TIM-3 antagonist.

Provided herein is an in vitro method for determining whether a subject having a cancer would respond to a treatment with a combination of a PD-1/PD-L1 axis antagonist and a TIM-3 antagonist, comprising determining a frequency of PD-1 positive tumor infiltrating lymphocytes (TILs) and a frequency of TIM-3 positive TILs in the subject, wherein a co-expression of PD-1 and TIM-3 on at least 5% of CD8+ TILs of the subject indicates that the subject is likely to respond to a treatment with a combination of a PD-1/PD-L1 axis antagonist and a TIM3 antagonist.

Also provided herein is a TIM-3 antagonist for use in the treatment of a subject having cancer, wherein the treatment comprises: (1) (a) determining a serum titer of soluble TIM-3 in the subject, and (b) administering the TIM-3 antagonist to the subject if (i) the serum titer of soluble TIM-3 is higher than that in healthy control subjects, or (ii) the serum titer of soluble TIM-3 is at least 2100, 2200, 2300, 2400, or 2500 pg/ml (as determined, e.g., in a method described in the Examples); (2) (a) determining a percentage of CD8+ TILs that are TIM-3 positive in the subject, and (b) administering the TIM-3 antagonist to the subject if the percentage is higher than 10%, 20%, 30%, 40%, 50%, 60% or 70%; (3) (a) determining a percentage of naïve, central memory (CM), effector memory (EM), and effector TILs that are TIM-3 positive, and (b) administering the TIM-3 antagonist to the subject if the percentage of EM TILs and/or effector TILs that are positive for TIM-3 is higher than the percentage of naïve TILs and/or CM TILs that are positive for TIM-3; or (4) (a) determining a percentage of dendritic cells, macrophages, and Natural Killer (NK) cells that are TIM-3 positive in TILs of the subject, and (b) administering the TIM-3 antagonist to the subject if the percentage is higher than that in control subjects (e.g., corresponding cancer patients who do not respond to treatment with a TIM-3 antagonist).

Present disclosure further provides a combination therapy, comprising a PD-1/PD-L1 axis antagonist and a TIM-3 antagonist, for use in the treatment of a subject having a cancer, wherein the treatment comprises (i) determining a frequency of PD-1 positive tumor infiltrating lymphocytes (TILs) and a frequency of TIM-3 positive TILs in the subject, and (ii) administering the combination therapy if at least 5% of CD8+ TILs co-express PD-1 and TIM-3.

In some embodiments, the TIM-3 antagonist for use in the treatment of a subject having cancer (e.g., monotherapy or combination therapy) is an anti-TIM3 antibody.

In some embodiments, the anti-TIM3 antibody comprises (i) a heavy chain variable region comprising CDR1, CDR2, and CDR3, and (ii) a light chain variable region comprising CDR1, CDR2, and CDR3, wherein:
(a) the heavy chain CDR1 comprises an amino acid sequence selected from the group consisting of SEQ ID NOs: 23-27;
(b) the heavy chain CDR2 comprises an amino acid sequence selected from the group consisting of SEQ ID NOs: 28-38;
(c) the heavy chain CDR3 comprises an amino acid sequence selected from the group consisting of SEQ ID NOs: 39-49;
(d) the light chain CDR1 comprises an amino acid sequence selected from the group consisting of SEQ ID NOs: 50 and 51;
(e) the light chain CDR2 comprises an amino acid sequence selected from the group consisting of SEQ ID NOs: 52 and 53; and
(f) the light chain CDR3 comprises an amino acid sequence selected from the group consisting of SEQ ID NOs: 54-57.

In some embodiments, the TILs are CD4+ TILs.

In some embodiments, the TILs are CD8+ TILs.

In some embodiments, the PD-1/PD-L1 axis antagonist comprises an anti-PD-1 antibody or an anti-PD-L1 antibody.

In some embodiments, the anti-PD-1 antibody comprises nivolumab, pembrolizumab, MEDI0608, AMP-224, PDR001, BGB-A317, or any combination thereof.

In some embodiments, the anti-PD-L1 antibody comprises BMS-936559, MPDL3280A, MEDI4736, MSB0010718C, or any combination thereof.

In some embodiments, the cancer comprises a colon, kidney, or lung cancer.

EMBODIMENTS

Embodiment 1. A method for determining whether a subject having cancer would respond to treatment with a TIM-3 antagonist, comprising determining the serum titer of soluble TIM-3 in the subject, and if the serum titer of soluble TIM-3 is higher than that in control subjects, the subject is likely to respond to a treatment with a TIM-3 antagonist.

Embodiment 2. The method of Embodiment 1, wherein, if the serum titer of soluble TIM-3 is at least 10% higher in the subject than in control subjects, the subject is likely to respond to a treatment with a TIM-3 antagonist.

Embodiment 3. The method of Embodiment 1 or 2, wherein, if the serum titer of soluble TIM-3 is at least 20%, 30%, 40%, 50%, 60%, 70%, 80%, 90% or 100% (2 fold) higher in the subject than that in control subjects, the subject is likely to respond to a treatment with a TIM-3 antagonist.

Embodiment 4. The method of any one of Embodiments 1-3, wherein, if the subject has a serum titer of soluble TIM-3 of at least 2100, 2200, 2300, 2400, or 2500 pg/ml (as determined, e.g., in a method described in the Examples), the subject is likely to respond to a treatment with a TIM-3 antagonist.

Embodiment 5. The method of any one of Embodiments 1-4, wherein, if the subject has a serum titer of soluble TIM-3 of at least 3000 pg/ml (as determined, e.g., in a method described in the Examples), the subject is likely to respond to a treatment with a TIM-3 antagonist.

Embodiment 6. The method of any one of Embodiments 1-5, further comprising administering a therapeutically effective amount of a TIM-3 antagonist to the subject who has a serum titer of soluble TIM-3 that is higher than that in control subjects.

Embodiment 7. A method of treating a subject having cancer, comprising administering to a subject having cancer and having a serum titer of soluble TIM-3 that is higher than that in control subjects, a therapeutically effective amount of a TIM-3 antagonist.

Embodiment 8. The method of Embodiment 7, wherein the subject has a serum titer of soluble TIM-3 that is at least 10% higher in the subject than in control subjects.

Embodiment 9. The method of Embodiment 7, wherein the subject has a serum titer of soluble TIM-3 that is at least 20%, 30%, 40%, 50%, 60%, 70%, 80%, 90% or 100% (2 fold) higher than that in control subjects.

Embodiment 10. The method of any one of Embodiments 7-9, wherein the subject has a serum titer of soluble TIM-3 of at least 2500 pg/ml (as determined, e.g., in a method described in the Examples).

Embodiment 11. The method of any one of Embodiments 7-10, wherein the subject has a serum titer of soluble TIM-3 of at least 3000 pg/ml (as determined, e.g., in a method described in the Examples).

Embodiment 12. The method of any one of Embodiments 7 to 11, further comprising measuring the serum titer of soluble TIM-3 prior to the administering.

Embodiment 13. A method of treating a subject having cancer with a TIM-3 antagonist, comprising determining the serum titer of soluble TIM-3 in the subject, and if the serum titer of soluble TIM-3 is higher than that in control subjects, administering to the subject a therapeutically effective amount of a TIM-3 antagonist.

Embodiment 14. The method of Embodiment 13, wherein, if the subject has a serum titer of soluble TIM-3 is at least 10% higher in the subject than in control subjects, the subject is administered a therapeutically effective amount of a TIM-3 antagonist.

Embodiment 15. The method of Embodiment 13 or 14, wherein, if the subject has a serum titer of soluble TIM-3 that is at least 20%, 30%, 40%, 50%, 60%, 70%, 80%, 90% or 100% (2 fold) higher than that in control subjects, the subject is administered a therapeutically effective amount of a TIM-3 antagonist.

Embodiment 16. The method of any one of Embodiments 13-15, wherein, if the subject has a serum titer of soluble TIM-3 of at least 2100, 2200, 2300, 2400, or 2500 pg/ml (as determined, e.g., in a method described in the Examples), the subject is administered a therapeutically effective amount of a TIM-3 antagonist.

Embodiment 17. The method of any one of Embodiments 13-16, wherein, if the subject has a serum titer of soluble TIM-3 of at least 3000 pg/ml (as determined, e.g., in a method described in the Examples), the subject is administered a therapeutically effective amount of a TIM-3 antagonist.

Embodiment 18. The method of any one of Embodiments 1-17, wherein the soluble TIM-3 is differentially spliced soluble TIM-3 and/or shed TIM-3.

Embodiment 19. The method of any one of Embodiments 1-18, wherein the cancer is a solid tumor.

Embodiment 20. The method of any one of Embodiments 1-19, wherein the cancer is colon, kidney or lung cancer.

Embodiment 21. The method of any one of Embodiments 1-20, wherein the serum titer of soluble TIM-3 in control subjects is the mean or average titer of soluble TIM-3 in at least 10, 50 or 100 subjects.

Embodiment 22. The method of any one of Embodiments 1-21, wherein the TIM-3 antagonist is a TIM-3 antibody.

Embodiment 23. The method of Embodiment 22, wherein the TIM-3 antibody comprises a heavy chain variable region comprising CDR1, CDR2, and CDR3 and a light chain variable region comprising CDR1, CDR2, and CDR3, wherein
(a) the heavy chain CDR1 comprises an amino acid sequence selected from the group consisting of SEQ ID NOs: 23-27;
(b) the heavy chain CDR2 comprises an amino acid sequence selected from the group consisting of SEQ ID NOs: 28-38;
(c) the heavy chain CDR3 comprises an amino acid sequence selected from the group consisting of SEQ ID NOs: 39-49;
(d) the light chain CDR1 comprises an amino acid sequence selected from the group consisting of SEQ ID NOs: 50 and 51;
(e) the light chain CDR2 comprises an amino acid sequence selected from the group consisting of SEQ ID NOs: 52 and 53; and
(f) the light chain CDR3 comprises an amino acid sequence selected from the group consisting of SEQ ID NOs: 54-57.

Embodiment 24. A method of determining whether a subject having cancer would respond to a treatment with a combination of a PD-1/PD-L1 axis antagonist and a TIM-3 antagonist, comprising determining the frequency of PD-1 positive tumor infiltrating lymphocytes (TILs) and the frequency of TIM-3 positive TILs of the subject, wherein co-expression of PD-1 and TIM-3 on at least 5% of the CD8+ TILs of the subject, indicates that the subject is likely to respond to a treatment with a combination of a PD-1/PD-L1 axis antagonist and a TIM3 antagonist.

Embodiment 25. The method of Embodiment 24, wherein co-expression of PD-1 and TIM-3 on at least 10%, 20%, 30%, or 40% of the CD8+ TILs of the subject, indicates that the subject is likely to respond to a treatment with a combination of a PD-1/PD-L1 axis antagonist and a TIM3 antagonist.

Embodiment 26. The method of Embodiment 24 or 25, further comprising administering to the subject who co-expresses PD-1 and TIM-3 on at least 5% of the CD8+ TILs a combination of a PD-1/PD-L1 axis antagonist and a TIM3 antagonist.

Embodiment 27. A method for treating a subject having cancer with a combination of a PD-1/PD-L1 axis antagonist and a TIM-3 antagonist, comprising administering to a subject having co-expression of PD-1 and TIM-3 on at least 5% of the CD8+ TILs a therapeutically effective amount of a combination of a PD-1/PD-L1 axis antagonist and a TIM-3 antagonist.

Embodiment 28. The method of Embodiment 27, wherein the subject has co-expression of PD-1 and TIM-3 on at least 10%, 20%, 30%, 40% of the CD8+ TILs.

Embodiment 29. A method of treating a subject having cancer with a combination of a PD-1/PD-L1 axis antagonist and a TIM-3 antagonist, comprising determining the frequency of PD-1 positive tumor infiltrating lymphocytes (TILs) and the frequency of TIM-3 positive TILs of the subject, and if PD-1 and TIM-3 are co-expressed on at least 5% of the CD8+ TILs of the subject, then administering to the subject a combination of a PD-1/PD-L1 axis antagonist and a TIM-3 antagonist.

Embodiment 30. The method of Embodiment 29, wherein, if PD-1 and TIM-3 are co-expressed on at least 10%, 20%, 30%, 40% of the CD8+ TILs of the CD8+ TILs of the subject, the subject is administered a combination of a PD-1/PD-L1 axis antagonist and a TIM-3 antagonist.

Embodiment 31. A method for determining whether a subject having cancer would respond to a treatment with a TIM-3 antagonist, comprising determining the percentage of CD8+ TILs that are TIM-3 positive, and if the percentage is higher than 10%, 20%, 30%, 40%, 50%, 60% or 70%, the subject is likely to respond to a treatment with a TIM-3 antagonist.

Embodiment 32. A method for treating a subject having cancer with a TIM-3 antagonist, comprising administering to a subject having a percentage of CD8+ TILs that is higher than 10%, 20%, 30%, 40%, 50%, 60% or 70%, a therapeutically effective amount of a TIM-3 antagonist.

Embodiment 33. A method for treating a subject having cancer with a TIM-3 antagonist, comprising determining the percentage of CD8+ TILs that are TIM-3 positive, and if the percentage is higher than 10%, 20%, 30%, 40%, 50%, 60% or 70%, administering to the subject a therapeutically effective amount of a TIM-3 antagonist.

Embodiment 34. A method for determining whether a subject having cancer would respond to a treatment with a TIM-3 antagonist, comprising determining the percentage of naïve, CM, EM and Teff TILs that are TIM-3 positive, and if the percentage of TIL effector memory ("EM") T cells and/or effector T ("Teff") cells that are positive for TIM-3 is higher than the percentage of TIL naïve T cells and/or central memory T cells ("CM T cells") that are positive for TIM-3, the subject is likely to respond to a treatment with a TIM-3 antagonist.

Embodiment 35. The method of Embodiment 34, wherein the TILs are CD4+ TILs.

Embodiment 36. The method of Embodiment 34, wherein the TILs are CD8+ TILs.

Embodiment 37. The method of Embodiment 34, wherein the frequencies are measured in CD4+ and CD8 T cells, and if the higher percentage is seen in both CD4+ and CD8+ TIL cells, then the subject is likely to respond to a treatment with a TIM-3 antagonist.

Embodiment 38. A method for treating a subject having cancer with a TIM-3 antagonist, comprising administering to a subject having a percentage of TIL effector memory ("EM") T cells and/or effector T ("Teff") cells that are positive for TIM-3 that is higher than the percentage of TIL naïve T cells and/or central memory T cells ("CM T cells") that are positive for TIM-3, a therapeutically effective amount of a TIM-3 antagonist.

Embodiment 39. A method for treating a subject having cancer with a TIM-3 antagonist, comprising administering to a subject having a percentage of CD4+ TIL effector memory ("EM") T cells and/or CD4+ effector T ("Teff") cells that are positive for TIM-3 that is higher than the percentage of CD4+ TIL naïve T cells and/or CD4+central memory T cells ("CM T cells") that are positive for TIM-3, a therapeutically effective amount of a TIM-3 antagonist.

Embodiment 40. A method for treating a subject having cancer with a TIM-3 antagonist, comprising administering to a subject having a percentage of CD8+ TIL effector memory ("EM") T cells and/or CD8+ effector T ("Teff") cells that are positive for TIM-3 that is higher than the percentage of CD8+ TIL naïve T cells and/or CD8+central memory T cells ("CM T cells") that are positive for TIM-3, a therapeutically effective amount of a TIM-3 antagonist.

Embodiment 41. A method for treating a subject having cancer with a TIM-3 antagonist, comprising administering to a subject having (i) a percentage of CD4+ TIL effector memory ("EM") T cells and/or CD4+ effector T ("Teff") cells that are positive for TIM-3 that is higher than the percentage of CD4+ TIL naïve T cells and/or CD4+central memory T cells ("CM T cells") that are positive for TIM-3; and (ii) a percentage of CD8+ TIL effector memory ("EM") T cells and/or CD8+ effector T ("Teff") cells that are positive for TIM-3 that is higher than the percentage of CD8+ TIL naïve T cells and/or CD8+central memory T cells ("CM T cells") that are positive for TIM-3, a therapeutically effective amount of a TIM-3 antagonist.

Embodiment 42. A method for treating a subject having cancer with a TIM-3 antagonist, comprising determining the percentage of naïve, CM, EM and Teff TILs that are TIM-3 positive, and if the percentage of TIL effector memory ("EM") T cells and/or effector T ("Teff") cells that are positive for TIM-3 is higher than the percentage of TIL naïve T cells and/or central memory T cells ("CM T cells") that are positive for TIM-3, administering to the subject a therapeutically effective amount of a TIM-3 antagonist.

Embodiment 43. The method of Embodiment 42, wherein the TILs are CD4+ TILs.

Embodiment 44. The method of Embodiment 42, wherein the TILs are CD8+ TILs.

Embodiment 45. The method of Embodiment 42, wherein the frequencies are measured in CD4+ and CD8 T cells, and if the higher percentage is seen in both CD4+ and CD8+ TIL cells, administering to the subject a therapeutically effective amount of a TIM-3 antagonist.

Embodiment 46. The method of any one of Embodiments 34-45, wherein the difference in level of TIM-3 positive cells is at least 50%.

Embodiment 47. The method of any one of Embodiments 34-46, wherein the difference in level of TIM-3 positive cells is at least 100%.

Embodiment 48. The method of any of Embodiments 34-47, wherein naïve T cells are CCR7+CD45RO−, Teff cells are CCR7−CD45RO−, CM T cells are CCR7+CD45RO+, and EM T cells are CCR7−CD45RO+.

Embodiment 49. A method for determining whether a subject having cancer would respond to a treatment with a TIM-3 antagonist, comprising determining the percentage of dendritic cells, macrophages, and Natural Killer (NK) cells that are TIM-3 positive in TILs of the subject, and if the percentage is higher than that in control subjects, the subject is likely to respond to a treatment with a TIM-3 antagonist.

Embodiment 50. A method for treating a subject having cancer with a TIM-3 antagonist, comprising administering to a subject having a percentage of dendritic cells, macrophages, and NK cells that are TIM-3 positive in TILs of the subject a therapeutically effective amount of a TIM-3 antagonist, wherein the percentage is higher than that in control subjects.

Embodiment 51. A method for treating a subject having cancer with a TIM-3 antagonist, comprising determining in the subject the percentage of dendritic cells, macrophages, and NK cells that are TIM-3 positive in TILs of the subject, and if the percentage is higher than that in control subjects, administering to the subject a therapeutically effective amount of a TIM-3 antagonist.

Embodiment 52. The method of any one of Embodiments 24-51, wherein the TIM-3 antagonist is a TIM-3 antibody.

Embodiment 53. The method of Embodiment 52, wherein the TIM-3 antibody comprises a heavy chain variable region comprising CDR1, CDR2, and CDR3 and a light chain variable region comprising CDR1, CDR2, and CDR3, wherein
(a) the heavy chain CDR1 comprises an amino acid sequence selected from the group consisting of SEQ ID NOs: 23-27;
(b) the heavy chain CDR2 comprises an amino acid sequence selected from the group consisting of SEQ ID NOs: 28-38;
(c) the heavy chain CDR3 comprises an amino acid sequence selected from the group consisting of SEQ ID NOs: 39-49;
(d) the light chain CDR1 comprises an amino acid sequence selected from the group consisting of SEQ ID NOs: 50 and 51;
(e) the light chain CDR2 comprises an amino acid sequence selected from the group consisting of SEQ ID NOs: 52 and 53; and
(f) the light chain CDR3 comprises an amino acid sequence selected from the group consisting of SEQ ID NOs: 54-57.

Embodiment 54. The method of Embodiment 52, wherein the VH comprises an amino acid sequence selected from the group consisting of SEQ ID NOs: 1-18 and the VL comprises an amino acid sequence selected from the group consisting of SEQ ID NOs: 19-22.

Embodiment 55. The method of any one of Embodiments 24 to 30, wherein the PD-1/PD-L1 axis antagonist is an anti-PD-1 antibody, an anti-PD-L1 antibody, or any combination thereof.

Embodiment 56. The method of Embodiment 55, wherein the anti-PD-1 antibody comprises nivolumab, pembrolizumab, MEDI0608, AMP-224, PDR001, BGB-A317, or any combination thereof.

Embodiment 57. The method of Embodiment 55, wherein the anti-PD-L1 antibody comprises BMS-936559, MPDL3280A, MEDI4736, MSB0010718C, or any combination thereof.

Embodiment 58. A method for assessing the efficacy of a treatment comprising a TIM-3 antagonist in a subject having a cancer, comprising determining a serum titer of soluble TIM-3 in the subject after administering the treatment to the subject, and if the serum titer is comparable to that of a control subject, the treatment is likely to be an efficacious treatment in the subject.

Embodiment 59. The method of Embodiment 58, wherein the efficacious treatment reduces a tumor size by at least about 10%, about 20%, about 30%, about 40%, or about 50% compared to the tumor size prior to the treatment.

Embodiment 60. The method of Embodiment 58 or 59, wherein the efficacious treatment effectively increases the overall survival of the subject by at least about 6 months, at least about 7 months, at least about 8 months, at least about 9 months, at least about 10 months, at least about 11 months, at least about 12 months, at least about 13 months, at least about 14 months at least about 15 months, at least about 16 months, at least about 17 months, at least about 18 months, at least about 19 months, at least about 20 months, at least about 21 months, at least about 22 months, at least about 23 months, at least about 24 months, at least about 25 months, at least about 26 months, at least about 27 months, at least about 28 months, at least about 29 months, at least about 30 months, at least about 3 years, at least about 3.5 years, at least about 4 years, at least about 4.5 years, at least about 5 years, or at least about 10 years.

Embodiment 61. The method of any one of Embodiments 58 to 60, wherein the efficacious treatment increases the duration of progression-free survival of the subject by at least about 1 month, at least about 2 months, at least about 3 months, at least about 4 months, at least about 5 months, at least about 6 months, at least about 7 months, at least about 8 months, at least about 9 months, at least about 10 months, at least about 11 months, at least about 1 year, at least about 15 months, at least about 18 months, at least about 2 years, at least about 3 years, at least about 4 years, or at least about 5 years.

Embodiment 62. The method of any one of Embodiments 58 to 61, wherein the TIM-3 antagonist is a TIM-3 antibody.

Embodiment 63. The method of Embodiment 62, wherein the TIM-3 antibody comprises a heavy chain variable region comprising CDR1, CDR2, and CDR3 and a light chain variable region comprising CDR1, CDR2, and CDR3, wherein
(a) the heavy chain CDR1 comprises an amino acid sequence selected from the group consisting of SEQ ID NOs: 23-27;
(b) the heavy chain CDR2 comprises an amino acid sequence selected from the group consisting of SEQ ID NOs: 28-38;
(c) the heavy chain CDR3 comprises an amino acid sequence selected from the group consisting of SEQ ID NOs: 39-49;
(d) the light chain CDR1 comprises an amino acid sequence selected from the group consisting of SEQ ID NOs: 50 and 51;
(e) the light chain CDR2 comprises an amino acid sequence selected from the group consisting of SEQ ID NOs: 52 and 53; and
(f) the light chain CDR3 comprises an amino acid sequence selected from the group consisting of SEQ ID NOs: 54-57.

Embodiment 64. The method of Embodiment 23 or 53, wherein the TIM-3 antibody comprises
(a1) the heavy chain variable region CDR1, CDR2, and CDR3 comprises SEQ ID NOs: 23, 28, 39, respectively, and the light chain variable region CDR1, CDR2, and CDR3 comprises SEQ ID NOs: 50, 52, 54, respectively;
(a2) the heavy chain variable region CDR1, CDR2, and CDR3 comprises SEQ ID NOs: 23, 35, 39, respectively, and the light chain variable region CDR1, CDR2, and CDR3 comprises SEQ ID NOs: 50, 52, 54, respectively;
(a3) the heavy chain variable region CDR1, CDR2, and CDR3 comprises SEQ ID NOs: 23, 36, 39, respectively, and the light chain variable region CDR1, CDR2, and CDR3 comprises SEQ ID NOs: 50, 52, 54, respectively;
(a4) the heavy chain variable region CDR1, CDR2, and CDR3 comprises SEQ ID NOs: 23, 37, 39, respectively, and the light chain variable region CDR1, CDR2, and CDR3 comprises SEQ ID NOs: 50, 52, 54, respectively;
(a5) the heavy chain variable region CDR1, CDR2, and CDR3 comprises SEQ ID NOs: 23, 28, 46, respectively, and the light chain variable region CDR1, CDR2, and CDR3 comprises SEQ ID NOs: 50, 52, 54, respectively;
(a6) the heavy chain variable region CDR1, CDR2, and CDR3 comprises SEQ ID NOs: 23, 28, 47, respectively, and the light chain variable region CDR1, CDR2, and CDR3 comprises SEQ ID NOs: 50, 52, 54, respectively;
(a7) the heavy chain variable region CDR1, CDR2, and CDR3 comprises SEQ ID NOs: 23, 28, 48, respectively, and the light chain variable region CDR1, CDR2, and CDR3 comprises SEQ ID NOs: 50, 52, 54, respectively;
(a8) the heavy chain variable region CDR1, CDR2, and CDR3 comprises SEQ ID NOs: 23, 28, 49, respectively, and the light chain variable region CDR1, CDR2, and CDR3 comprises SEQ ID NOs: 50, 52, 54, respectively;
(a9) the heavy chain variable region CDR1, CDR2, and CDR3 comprises SEQ ID NOs: 23, 35, 46, respectively, and the light chain variable region CDR1, CDR2, and CDR3 comprises SEQ ID NOs: 50, 52, 54, respectively;
(a10) the heavy chain variable region CDR1, CDR2, and CDR3 comprises SEQ ID NOs: 23, 35, 48, respectively, and the light chain variable region CDR1, CDR2, and CDR3 comprises SEQ ID NOs: 50, 52, 54, respectively;
(b1) the heavy chain variable region CDR1, CDR2, and CDR3 comprises SEQ ID NOs: 24, 29, 40, respectively, and the light chain variable region CDR1, CDR2, and CDR3 comprises SEQ ID NOs: 50, 52, 55, respectively;
(b2) the heavy chain variable region CDR1, CDR2, and CDR3 comprises SEQ ID NOs: 24, 38, 40, respectively, and the light chain variable region CDR1, CDR2, and CDR3 comprises SEQ ID NOs: 50, 52, 55, respectively;
(c) the heavy chain variable region CDR1, CDR2, and CDR3 comprises SEQ ID NOs: 25, 30, 41, respectively, and the light chain variable region CDR1, CDR2, and CDR3 comprises SEQ ID NOs: 50, 52, 55, respectively;
(d) the heavy chain variable region CDR1, CDR2, and CDR3 comprises SEQ ID NOs: 26, 31, 42, respectively, and the light chain variable region CDR1, CDR2, and CDR3 comprises SEQ ID NOs: 50, 52, 54, respectively;
(e) the heavy chain variable region CDR1, CDR2, and CDR3 comprises SEQ ID NOs: 27, 32, 43, respectively, and the light chain variable region CDR1, CDR2, and CDR3 comprises SEQ ID NOs: 50, 52, 55, respectively;
(f) the heavy chain variable region CDR1, CDR2, and CDR3 comprises SEQ ID NOs: 27, 32, 43, respectively, and the light chain variable region CDR1, CDR2, and CDR3 comprises SEQ ID NOs: 50, 52, 57, respectively;
(g1) the heavy chain variable region CDR1, CDR2, and CDR3 comprises SEQ ID NOs: 27, 32, 43, respectively, and the light chain variable region CDR1, CDR2, and CDR3 comprises SEQ ID NOs: 51, 53, 56, respectively;
(g2) the heavy chain variable region CDR1, CDR2, and CDR3 comprises SEQ ID NOs: 27, 32, 43, respectively, and the light chain variable region CDR1, CDR2, and CDR3 comprises SEQ ID NOs: 50, 52, 57, respectively;
(g3) the heavy chain variable region CDR1, CDR2, and CDR3 comprises SEQ ID NOs: 27, 32, 43, respectively, and the light chain variable region CDR1, CDR2, and CDR3 comprises SEQ ID NOs: 50, 52, 55, respectively;
(h) the heavy chain variable region CDR1, CDR2, and CDR3 comprises SEQ ID NOs: 27, 33, 44, respectively, and the light chain variable region CDR1, CDR2, and CDR3 comprises SEQ ID NOs: 50, 52, 54 respectively; or
(i) the heavy chain variable region CDR1, CDR2, and CDR3 comprises SEQ ID NOs: 27, 34, 45, respectively, and the light chain variable region CDR1, CDR2, and CDR3 comprises SEQ ID NOs: 50, 52, 55, respectively;
wherein the antibody specifically binds to human TIM3.

Embodiment 65. The method of Embodiment 23 or 53, wherein the TIM-3 antibody comprises a heavy chain variable region (VH) and a light chain variable region (VL), wherein the VH and the VL are selected from the group consisting of:
(a) VH and VL comprising SEQ ID NOs: 1 and 19, respectively;
(b) VH and VL comprising SEQ ID NOs: 2 and 20, respectively;

(c) VH and VL comprising SEQ ID NOs: 3 and 20, respectively;
(d) VH and VL comprising SEQ ID NOs: 4 and 19, respectively;
(e) VH and VL comprising SEQ ID NOs: 5 and 20, respectively;
(f) VH and VL comprising SEQ ID NOs: 5 and 21, respectively;
(g) VH and VL comprising SEQ ID NOs: 5 and 22, respectively;
(h) VH and VL comprising SEQ ID NOs: 6 and 19, respectively;
(i) VH and VL comprising SEQ ID NOs: 7 and 20, respectively;
(j) VH and VL comprising SEQ ID NOs: 17 and 22, respectively;
(k) VH and VL comprising SEQ ID NOs: 16 and 20, respectively;
(l) VH and VL comprising SEQ ID NOs: 8 and 19, respectively;
(m) VH and VL comprising SEQ ID NOs: 9 and 19, respectively;
(n) VH and VL comprising SEQ ID NOs: 10 and 19, respectively;
(o) VH and VL comprising SEQ ID NOs: 11 and 19, respectively;
(p) VH and VL comprising SEQ ID NOs: 12 and 19, respectively;
(q) VH and VL comprising SEQ ID NOs: 13 and 19, respectively;
(r) VH and VL comprising SEQ ID NOs: 14 and 19, respectively;
(s) VH and VL comprising SEQ ID NOs: 15 and 19, respectively; and
(t) VH and VL comprising SEQ ID NOs: 18 and 19, respectively.

Embodiment 66. The method of Embodiment 23 or 53, wherein the TIM-3 antibody comprises:
(a1) heavy and light chain sequences comprising SEQ ID NOs: 136 (or 137) and 190, respectively;
(a2) heavy and light chain sequences comprising SEQ ID NOs: 68 (or 75) and 190, respectively;
(a3) heavy and light chain sequences comprising SEQ ID NOs: 82 (or 89)) and 190, respectively;
(a4) heavy and light chain sequences comprising SEQ ID NOs: 138 (or 139) and 190, respectively;
(a5) heavy and light chain sequences comprising SEQ ID NOs: 96 (or 106) and 190, respectively;
(a6) heavy and light chain sequences comprising SEQ ID NOs: 116 (or 126) and 190, respectively;
(a7) heavy and light chain sequences comprising SEQ ID NOs: 140 (or 141) and 190, respectively;
(a8) heavy and light chain sequences comprising SEQ ID NOs: 97 (or 107) and 190, respectively;
(a9) heavy and light chain sequences comprising SEQ ID NOs: 117 (or 127) and 190, respectively;
(a10) heavy and light chain sequences comprising SEQ ID NOs:142 (or 143) and 190, respectively;
(a11) heavy and light chain sequences comprising SEQ ID NOs: 98 (or 108) and 190, respectively;
(a12) heavy and light chain sequences comprising SEQ ID NOs: 118 (or 128) and 190, respectively;
(a13) heavy and light chain sequences comprising SEQ ID NOs: 144 (or 145) and 190, respectively;
(a14) heavy and light chain sequences comprising SEQ ID NOs: 99 (or 109) and 190, respectively;
(a15) heavy and light chain sequences comprising SEQ ID NOs: 119 (or 129) and 190, respectively;
(a16) heavy and light chain sequences comprising SEQ ID NOs: 146 (or 147) and 190, respectively;
(a17) heavy and light chain sequences comprising SEQ ID NOs: 100 (or 110) and 190, respectively;
(a18) heavy and light chain sequences comprising SEQ ID NOs: 120 (or 130) and 190, respectively;
(a19) heavy and light chain sequences comprising SEQ ID NOs:148 (or 149) and 190, respectively;
(a20) heavy and light chain sequences comprising SEQ ID NOs: 101 (or 111) and 190, respectively;
(a21) heavy and light chain sequences comprising SEQ ID NOs: 121 (or 131) and 190, respectively;
(a22) heavy and light chain sequences comprising SEQ ID NOs: 150 (or 151) and 190, respectively;
(a23) heavy and light chain sequences comprising SEQ ID NOs: 102 (or 112) and 190, respectively;
(a24) heavy and light chain sequences comprising SEQ ID NOs: 122 (or 132) and 190, respectively;
(a25) heavy and light chain sequences comprising SEQ ID NOs: 152 (or 153) and 190, respectively;
(a26) heavy and light chain sequences comprising SEQ ID NOs: 103 (or 113) and 190, respectively;
(a27) heavy and light chain sequences comprising SEQ ID NOs: 123 (or 133) and 190, respectively;
(a28) heavy and light chain sequences comprising SEQ ID NOs: 154 (or 155) and 190, respectively;
(a29) heavy and light chain sequences comprising SEQ ID NOs: 184 (or 185) and 190, respectively;
(a30) heavy and light chain sequences comprising SEQ ID NOs: 186 (or 187) and 190, respectively;
(a31) heavy and light chain sequences comprising SEQ ID NOs: 188 (or 189) and 190, respectively;
(b1) heavy and light chain sequences comprising SEQ ID NOs: 156 (or 157) and 191, respectively;
(b2) heavy and light chain sequences comprising SEQ ID NOs: 69 (or 76) and 191, respectively;
(b3) heavy and light chain sequences comprising SEQ ID NOs: 83 (or 90) and 191, respectively;
(b4) heavy and light chain sequences comprising SEQ ID NOs:158 (or 159) and 191, respectively;
(b5) heavy and light chain sequences comprising SEQ ID NOs: 104 (or 114) and 191, respectively;
(b6) heavy and light chain sequences comprising SEQ ID NOs: 124 (or 134) and 191, respectively;
(b7) heavy and light chain sequences comprising SEQ ID NOs: 160 (or 161) and 191, respectively;
(c1) heavy and light chain sequences comprising SEQ ID NOs: 162 (or 163) and 191, respectively;
(c2) heavy and light chain sequences comprising SEQ ID NOs: 70 (or 77) and 191, respectively;
(c3) heavy and light chain sequences comprising SEQ ID NOs: 84 (or 91) and 191, respectively;
(c4) heavy and light chain sequences comprising SEQ ID NOs: 164 (or 165) and 191, respectively;
(d1) heavy and light chain sequences comprising SEQ ID NOs: 166 (or 167) and 190, respectively;
(d2) heavy and light chain sequences comprising SEQ ID NOs: 71 (or 78) and 190, respectively;
(d3) heavy and light chain sequences comprising SEQ ID NOs: 85 (or 92) and 190, respectively;
(d4) heavy and light chain sequences comprising SEQ ID NOs: 168 (or 169) and 190, respectively;
(e1.1) heavy and light chain sequences comprising SEQ ID NOs: 170 (or 171) and 192, respectively;

(e1.2) heavy and light chain sequences comprising SEQ ID NOs: 170 (or 171) and 193, respectively;
(e1.3) heavy and light chain sequences comprising SEQ ID NOs: 170 (or 171) and 191, respectively;
(e2) heavy and light chain sequences comprising SEQ ID NOs: 72 (or 79) and 193, respectively;
(e3) heavy and light chain sequences comprising SEQ ID NOs: 86 (or 93) and 193, respectively;
(e4) heavy and light chain sequences comprising SEQ ID NOs: 172 (or 173) and 193, respectively;
(e5) heavy and light chain sequences comprising SEQ ID NOs: 105 (or 115) and 193, respectively;
(e6) heavy and light chain sequences comprising SEQ ID NOs: 125 (or 135) and 193, respectively;
(e7) heavy and light chain sequences comprising SEQ ID NOs: 174 (or 175) and 193, respectively;
(f1) heavy and light chain sequences comprising SEQ ID NOs: 176 (or 177) and 190, respectively;
(f2) heavy and light chain sequences comprising SEQ ID NOs: 73 (or 80) and 190, respectively;
(f3) heavy and light chain sequences comprising SEQ ID NOs: 87 (or 94) and 190, respectively;
(f4) heavy and light chain sequences comprising SEQ ID NOs: 178 (or 179) and 190, respectively;
(g1) heavy and light chain sequences comprising SEQ ID NOs: 180 (or 181) and 191, respectively;
(g2) heavy and light chain sequences comprising SEQ ID NOs: 74 (or 81) and 191, respectively;
(g3) heavy and light chain sequences comprising SEQ ID NOs: 88 (or 95) and 191, respectively; or
(g4) heavy and light chain sequences comprising SEQ ID NOs: 182 (or 183) and 191, respectively;
wherein the antibody specifically binds to human TIM3.

Embodiment 67. A method of treating a subject having cancer, comprising administering to a subject having cancer and having a serum titer of soluble TIM-3 that is higher than that in control subjects, a therapeutically effective amount of a TIM-3 antagonist, wherein the TIM-3 antagonist is an antibody that comprises a heavy chain and a light chain, wherein (i) the heavy chain comprises a heavy chain CDR1, CDR2 and CDR3 comprising SEQ ID NOs: 23, 35 and 46, respectively, and the light chain comprises a light chain CDR1, CDR2 and CDR3 comprising SEQ ID NOs: 50, 52 and 54, respectively; (ii) the heavy chain comprises a VH comprising SEQ ID NO: 18 and the light chain comprises a VL comprising SEQ ID NO: 19; or (iii) the heavy chain comprises SEQ ID NO: 186 or 187 and the light chain comprises SEQ ID NO: 190.

Embodiment 68. The method of Embodiment 67, wherein the subject has a serum titer of soluble TIM-3 that is at least 10% higher in the subject than in control subjects.

Embodiment 69. The method of Embodiment 67, wherein the subject has a serum titer of soluble TIM-3 that is at least 20%, 30%, 40%, 50%, 60%, 70%, 80%, 90% or 100% (2 fold) higher than that in control subjects.

Embodiment 70. The method of any one of Embodiments 67-69, wherein the subject has a serum titer of soluble TIM-3 of at least 2100, 2200, 2300, 2400 or 2500 pg/ml (as determined, e.g., in a method described in the Examples).

Embodiment 71. The method of any one of Embodiments 67-70, wherein the subject has a serum titer of soluble TIM-3 of at least 3000 pg/ml (as determined, e.g., in a method described in the Examples).

Embodiment 72. The method of any one of Embodiments 67 to 71, further comprising measuring the serum titer of soluble TIM-3 prior to the administering.

Embodiment 73. A method of treating a subject having cancer with a TIM-3 antagonist, comprising determining the serum titer of soluble TIM-3 in the subject, and if the serum titer of soluble TIM-3 is higher than that in control subjects, administering to the subject a therapeutically effective amount of a TIM-3 antagonist, wherein the TIM-3 antagonist is an antibody that comprises a heavy chain and a light chain, wherein (i) the heavy chain comprises a heavy chain CDR1, CDR2 and CDR3 comprising SEQ ID NOs: 23, 35 and 46, respectively, and the light chain comprises a light chain CDR1, CDR2 and CDR3 comprising SEQ ID NOs: 50, 52 and 54, respectively; (ii) the heavy chain comprises a VH comprising SEQ ID NO: 18 and the light chain comprises a VL comprising SEQ ID NO: 19; or (iii) the heavy chain comprises SEQ ID NO: 186 or 187 and the light chain comprises SEQ ID NO: 190.

Embodiment 74. The method of Embodiment 73, wherein, if the subject has a serum titer of soluble TIM-3 is at least 10% higher in the subject than in control subjects, the subject is administered a therapeutically effective amount of a TIM-3 antagonist.

Embodiment 75. The method of Embodiment 73 or 74, wherein, if the subject has a serum titer of soluble TIM-3 that is at least 20%, 30%, 40%, 50%, 60%, 70%, 80%, 90% or 100% (2 fold) higher than that in control subjects, the subject is administered a therapeutically effective amount of a TIM-3 antagonist.

Embodiment 76. The method of any one of Embodiments 73-75, wherein, if the subject has a serum titer of soluble TIM-3 of at least 2500 pg/ml (as determined, e.g., in a method described in the Examples), the subject is administered a therapeutically effective amount of a TIM-3 antagonist.

Embodiment 77. The method of any one of Embodiments 73-76, wherein, if the subject has a serum titer of soluble TIM-3 of at least 3000 pg/ml (as determined, e.g., in a method described in the Examples), the subject is administered a therapeutically effective amount of a TIM-3 antagonist.

Embodiment 78. The method of any one of Embodiments 67-77, wherein the soluble TIM-3 is differentially spliced soluble TIM-3 and/or shed TIM-3.

Embodiment 79. The method of any one of Embodiments 67-78, wherein the cancer is a solid tumor.

Embodiment 80. The method of any one of Embodiments 67-79, wherein the cancer is colon, kidney or lung cancer.

Embodiment 81. The method of any one of Embodiments 67-80, wherein the serum titer of soluble TIM-3 in control subjects is the mean or average titer of soluble TIM-3 in at least 10, 50 or 100 subjects.

Embodiment 82. The method of any one of Embodiments 67-81, wherein the TIM-3 antagonist is a TIM-3 antibody.

Embodiment 83. A method for treating a subject having cancer with a combination of a PD-1/PD-L1 axis antagonist and a TIM-3 antagonist, comprising administering to a subject having co-expression of PD-1 and TIM-3 on at least 5% of the CD8+ TILs a therapeutically effective amount of a combination of a PD-1/PD-L1 axis antagonist and a TIM-3 antagonist, wherein the TIM-3 antagonist is an antibody that comprises a heavy chain and a light chain, wherein (i) the heavy chain comprises a heavy chain CDR1, CDR2 and CDR3 comprising SEQ ID NOs: 23, 35 and 46, respectively, and the light chain comprises a light chain CDR1, CDR2 and CDR3 comprising SEQ ID NOs: 50, 52 and 54, respectively; (ii) the heavy chain comprises a VH comprising SEQ ID NO: 18 and the light chain comprises a VL comprising SEQ ID NO: 19; or (iii) the heavy chain comprises SEQ ID NO:

186 or 187 and the light chain comprises SEQ ID NO: 190, and wherein the PD-1 antagonist is nivolumab.

Embodiment 84. The method of Embodiment 83, wherein the subject has co-expression of PD-1 and TIM-3 on at least 10%, 20%, 30%, 40% of the CD8+ TILs.

Embodiment 85. A method of treating a subject having cancer with a combination of a PD-1/PD-L1 axis antagonist and a TIM-3 antagonist, comprising determining the frequency of PD-1 positive tumor infiltrating lymphocytes (TILs) and the frequency of TIM-3 positive TILs of the subject, and if PD-1 and TIM-3 are co-expressed on at least 5% of the CD8+ TILs of the subject, then administering to the subject a combination of a PD-1/PD-L1 axis antagonist and a TIM-3 antagonist, wherein the TIM-3 antagonist is an antibody that comprises a heavy chain and a light chain, wherein (i) the heavy chain comprises a heavy chain CDR1, CDR2 and CDR3 comprising SEQ ID NOs: 23, 35 and 46, respectively, and the light chain comprises a light chain CDR1, CDR2 and CDR3 comprising SEQ ID NOs: 50, 52 and 54, respectively; (ii) the heavy chain comprises a VH comprising SEQ ID NO: 18 and the light chain comprises a VL comprising SEQ ID NO: 19; or (iii) the heavy chain comprises SEQ ID NO: 186 or 187 and the light chain comprises SEQ ID NO: 190, and the PD-1 antagonist is nivolumab.

Embodiment 86. The method of Embodiment 85, wherein, if PD-1 and TIM-3 are co-expressed on at least 10%, 20%, 30%, 40% of the CD8+ TILs of the CD8+ TILs of the subject, the subject is administered a combination of a PD-1/PD-L1 axis antagonist and a TIM-3 antagonist.

Embodiment 87. A method for treating a subject having cancer with a TIM-3 antagonist, comprising administering to a subject having a percentage of CD8+ TILs that is higher than 10%, 20%, 30%, 40%, 50%, 60% or 70%, a therapeutically effective amount of a TIM-3 antagonist, wherein the TIM-3 antagonist is an antibody that comprises a heavy chain and a light chain, wherein (i) the heavy chain comprises a heavy chain CDR1, CDR2 and CDR3 comprising SEQ ID NOs: 23, 35 and 46, respectively, and the light chain comprises a light chain CDR1, CDR2 and CDR3 comprising SEQ ID NOs: 50, 52 and 54, respectively; (ii) the heavy chain comprises a VH comprising SEQ ID NO: 18 and the light chain comprises a VL comprising SEQ ID NO: 19; or (iii) the heavy chain comprises SEQ ID NO: 186 or 187 and the light chain comprises SEQ ID NO: 190.

Embodiment 88. A method for treating a subject having cancer with a TIM-3 antagonist, comprising determining the percentage of CD8+ TILs that are TIM-3 positive, and if the percentage is higher than 10%, 20%, 30%, 40%, 50%, 60% or 70%, administering to the subject a therapeutically effective amount of a TIM-3 antagonist, wherein the TIM-3 antagonist is an antibody that comprises a heavy chain and a light chain, wherein (i) the heavy chain comprises a heavy chain CDR1, CDR2 and CDR3 comprising SEQ ID NOs: 23, 35 and 46, respectively, and the light chain comprises a light chain CDR1, CDR2 and CDR3 comprising SEQ ID NOs: 50, 52 and 54, respectively; (ii) the heavy chain comprises a VH comprising SEQ ID NO: 18 and the light chain comprises a VL comprising SEQ ID NO: 19; or (iii) the heavy chain comprises SEQ ID NO: 186 or 187 and the light chain comprises SEQ ID NO: 190.

Embodiment 89. A method for treating a subject having cancer with a TIM-3 antagonist, comprising administering to a subject having a percentage of dendritic cells, macrophages, and NK cells that are TIM-3 positive in TILs of the subject a therapeutically effective amount of a TIM-3 antagonist, wherein the percentage is higher than that in control subjects, wherein the TIM-3 antagonist is an antibody that comprises a heavy chain and a light chain, wherein (i) the heavy chain comprises a heavy chain CDR1, CDR2 and CDR3 comprising SEQ ID NOs: 23, 35 and 46, respectively, and the light chain comprises a light chain CDR1, CDR2 and CDR3 comprising SEQ ID NOs: 50, 52 and 54, respectively; (ii) the heavy chain comprises a VH comprising SEQ ID NO: 18 and the light chain comprises a VL comprising SEQ ID NO: 19; or (iii) the heavy chain comprises SEQ ID NO: 186 or 187 and the light chain comprises SEQ ID NO: 190.

Embodiment 90. A method for treating a subject having cancer with a TIM-3 antagonist, comprising determining in the subject the percentage of dendritic cells, macrophages, and NK cells that are TIM-3 positive in TILs of the subject, and if the percentage is higher than that in control subjects, administering to the subject a therapeutically effective amount of a TIM-3 antagonist, wherein the TIM-3 antagonist is an antibody that comprises a heavy chain and a light chain, wherein (i) the heavy chain comprises a heavy chain CDR1, CDR2 and CDR3 comprising SEQ ID NOs: 23, 35 and 46, respectively, and the light chain comprises a light chain CDR1, CDR2 and CDR3 comprising SEQ ID NOs: 50, 52 and 54, respectively; (ii) the heavy chain comprises a VH comprising SEQ ID NO: 18 and the light chain comprises a VL comprising SEQ ID NO: 19; or (iii) the heavy chain comprises SEQ ID NO: 186 or 187 and the light chain comprises SEQ ID NO: 190.

BRIEF DESCRIPTION OF THE FIGURES

In FIGS. 2A and 2B, the frequencies of TIM3+ cells are shown as a percentage of total CD4+ and CD8+ T cells in the TILs, respectively. The frequencies of TIM3+ CD4+ and TIM3+ CD8+ T cells that also express PD-1 in the TILs are shown in FIGS. 2C and 2D, respectively. In FIGS. 2C and 2D, the frequencies of PD-1+ cells are shown as a percentage of TIM3+ CD4+ and TIM3+ CD8+ T cells in the TILs, respectively. FIG. 2E shows a comparison of PD-1 expression on CD8+ T cells in the TILs from all cancer patients with low frequencies of TIM3+ CD8+ T cells (<8%) (left column) and high frequencies of TIM3+ CD8+ T cells (right column). The frequencies of PD-1 positive expression are shown as a percentage of TIM3+ CD8+ T cells. The P value shown was calculated using the Mann Whitney test.

FIG. 3A provides the gating strategy to identify the different CD4+ and CD8+ T cell subsets: naïve (CCR7+ CD45RO−), central memory (CCR7+ CD45RO+), effector memory (CCR7−CD45RO+), and effector (CCR7− CD45RO−). FIG. 3B shows the frequencies of different CD4+ (top panel) and CD8+ (bottom panel) T cell subsets that express TIM3 in the TILs (n=27) from different cancer patients. The frequencies shown are a percentage of the TIM3+ cells within CD4+ or CD8+ T cell subsets described above. FIG. 3C shows a comparison of the frequencies of TIM3+ cells in different CD4+ and CD8+ T cell subsets between the TILs and the matching blood.

FIG. 4A shows the frequencies of CD8+ T cells that (i) only express PD-1 (lighter shade of gray), (ii) only express TIM3 (darker shade of gray), and (ii) express both PD-1 and TIM3 (black). The x-axis represents individual cancer patients. FIG. 4B shows the flow cytometry analysis of the frequencies of CD8+ (left panel) and CD4+ (right panel) T cells that express (i) only PD-1 (upper left quadrant in each panel), (ii) only TIM3 (bottom right quadrant in each panel), and (ii) both PD-1 and TIM3 (upper right quadrant in each panel).

In FIG. 5A, the frequencies of (i) TIM3+ CD15+ granulocytes, (ii) TIM3+ plasmacytoid dendritic cells (pDCs), (iii) TIM3+ myeloid dendritic cells (mDCs), and (iv) TIM3+ monocytes/macrophages (CD14+ CD64+) in the TILs from 10 cancer patients are shown. In FIG. 5B, the frequencies of TIM3+ CD16– CD56++ and CD16+ CD56+ CD3– NK cells in the TILs from 10 cancer patients are shown.

FIG. 6A shows the data for each of the donors. FIG. 6B shows the same data as a box plot. The TIM3 protein levels were measured by ELISA using serum from the different patients (n=20). "**" above the data points indicates a statistically significant difference (p<0.0001) between the normal and cancer patients. "" above the data points indicates a statistically significant difference (p<0.01) between the normal and cancer patients. The p values were calculated using the Mann Whitney test.

DETAILED DESCRIPTION OF THE DISCLOSURE

Definitions

Figure 1A:
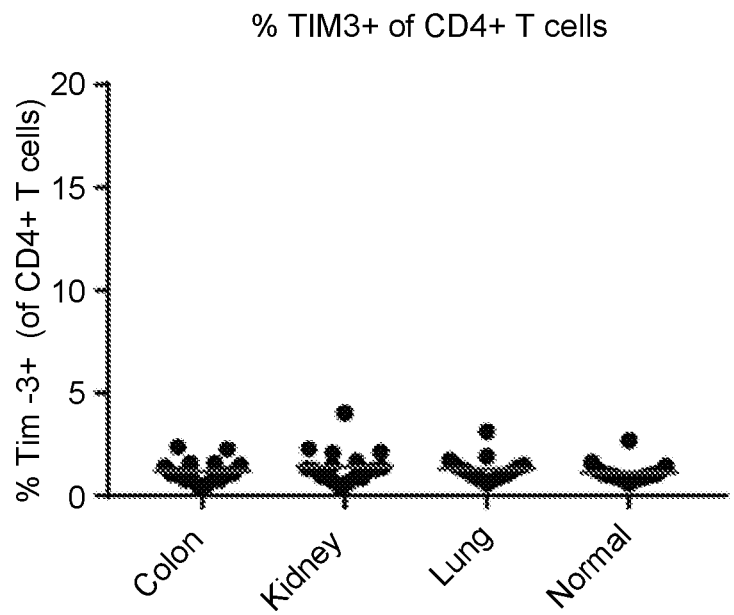
FIGS. 1A and 1B show the frequencies of TIM3+ CD4+ T cells (FIG. 1A) and TIM3+ CD8+ T cells (FIG. 1B) in the peripheral blood from healthy human subjects ("Normal") and cancer patients (i.e., colon, kidney, or lung). The frequencies are shown as a percentage of total CD4+ T cells or CD8+ T cells. Each circle represents an individual patient and the mean for each of the groups is shown by a horizontal line.

In order that the present description can be more readily understood, certain terms are first defined. Additional definitions are set forth throughout the detailed description.

It is to be noted that the term "a" or "an" entity refers to one or more of that entity; for example, "a nucleotide sequence," is understood to represent one or more nucleotide sequences. As such, the terms "a" (or "an"), "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

It is understood that wherever aspects are described herein with the language "comprising," otherwise analogous aspects described in terms of "consisting of" and/or "consisting essentially of" are also provided.

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Units, prefixes, and symbols are denoted in their Système International de Unites (SI) accepted form. Numeric ranges are inclusive of the numbers defining the range. Unless otherwise indicated, nucleotide sequences are written left to right in 5' to 3' orientation. Amino acid sequences are written left to right in amino to carboxy orientation. The headings provided herein are not limitations of the various aspects of the disclosure, which can be had by reference to the specification as a whole. Accordingly, the terms defined immediately below are more fully defined by reference to the specification in its entirety.

The term "about" is used herein to mean approximately, roughly, around, or in the regions of. When the term "about" is used in conjunction with a numerical range, it modifies that range by extending the boundaries above and below the numerical values set forth. In general, the term "about" can modify a numerical value above and below the stated value by a variance of, e.g., 10 percent, up or down (higher or lower).

The term "T-cell immunoglobulin and mucin-domain containing-3," "TIM3," or "TIM-3" as used herein refers to a receptor that is a member of the T cell immunoglobulin and mucin domain (TIM) family of proteins. Primary ligand for TIM3 include phosphatidylserine (TIM3-L). TIM3 is also referred to as hepatitis A virus cellular receptor 2 (HAVCR2), T-cell immunoglobulin mucin receptor 3, TIM-3, TIMD3, TIMD-3, Kidney Injury Molecule-3, KIM-3, and CD366. The term "TIM3" includes any variants or isoforms of TIM3 which are naturally expressed by cells. Accordingly, antibodies described herein can cross-react with TIM3 from species other than human (e.g., cynomolgus TIM3). Alternatively, the antibodies can be specific for human TIM3 and do not exhibit any cross-reactivity with other species. TIM3 or any variants and isoforms thereof, can either be isolated from cells or tissues which naturally express them or be recombinantly produced using well-known techniques in the art and/or those described herein.

Two isoforms of human TIM3 have been identified. Isoform 1 (Accession No. NP_116171; SEQ ID NO: 194) consists of 301 amino acids and represents the canonical sequence. Isoform 2 (Accession No. AAH20843; SEQ ID NO: 195) consists of 142 amino acids, and is soluble. It lacks amino acid residues 143-301, which encode the transmembrane domain, the cytoplasmic domain, and part of the extracellular domain of TIM3. The amino acid residues 132-142 also differ from the canonical sequence described above.

Below are the amino acid sequences of the two known human TIM3 isoforms:

```
(A) Human TIM3 isoform 1 (Accession No. NP_116171;
SEQ ID NO: 194; encoded by the nucleotide sequence
having Accession No. NM_032782.4; SEQ ID NO: 196):
MFSHLPFDCVLLLLLLLLTRSSEVEYRAEVGQNAYLPCFYTPAAPGNLVP

VCWGKGACPVFECGNVVLRTDERDVNYWTSRYWLNGDFRKGDVSLTIENV

TLADSGIYCCRIQIPGIMNDEKFNLKLVIKPAKVTPAPTRQRDFTAAFPR

MLTTRGHGPAETQTLGSLPDINLTQISTLANELRDSRLANDLRDSGATIR

IGIYIGAGICAGLALALIFGALIFKWYSHSKEKIQNLSLISLANLPPSGL

ANAVAEGIRSEENIYTIEENVYEVEEPNEYYCYVSSRQQPSQPLGCRFAM

P (B) Human TIM3 isoform 2 (Accession No. AAH20843;
SEQ ID NO: 195; encoded by the nucleotide sequence
having Accession No. BC020843.1; SEQ ID NO: 197):
MFSHLPFDCVLLLLLLLLTRSSEVEYRAEVGQNAYLPCFYTPAAPGNLVP

VCWGKGACPVFECGNVVLRTDERDVNYWTSRYWLNGDFRKGDVSLTIENV

TLADSGIYCCRIQIPGIMNDEKFNLKLVIKPGEWTFACHLYE
```

The signal sequence of isoforms 1 and 2 corresponds to amino acids 1-21 (underlined). Thus, the mature isoforms 1 and 2 consist of amino acids 22 to 301 or 142, respectively. The extracellular domain of mature human TIM3 consists of amino acids 22-202 of SEQ ID NO: 194 and has the amino acid sequence:

```
                                          (SEQ ID NO: 198)
SEVEYRAEVGQNAYLPCFYTPAAPGNLVPVCWGKGACPVFECGNVVLRTD

ERDVNYWTSRYWLNGDFRKGDVSLTIENVTLADSGIYCCRIQIPGIMNDE

KFNLKLVIKPAKVTPAPTRQRDFTAAFPRMLTTRGHGPAETQTLGSLPDI

NLTQISTLANELRDSRLANDLRDSGATIRIG.
```

Cynomolgus TIM3 protein consists of the following amino acid sequence (including a signal sequence):

```
                                          (SEQ ID NO: 199)
MFSHLPFDCVLLLLLLLLTRSSEVEYIAEVGQNAYLPCSYTPAPPGNLV

PVCWGKGACPVFDCSNVVLRTENRDVNDRTSGRYWLKGDFHKGDVSLTI

ENVTLADSGVYCCRIQIPGIMNDEKHNLKLVVIKPAKVTPAPTLQRDLT

SAFPRMLTTGEHGPAETQTPGSLPDVNLTQIFTLTNELRDSGATIRTAI

YIAAGISAGLALALIFGALIFKWYSHSKEKTQNLSLISLANIPPSGLAN

AVAEGIRSEENIYTIEEDVYEVEEPNEYYCYVSSGQQPSQPLGCRFAMP
```

The term "TIM3 antagonist" or "antagonist against TIM3" refer to all antagonists that bind to human TIM3 protein or ligand thereof or nucleic acid encoding human TIM3 or ligand thereof, respectively, and suppress or inhibit human TIM3 activity. Such antagonist can be a peptide, nucleic acid, or a compound. More specifically, the antagonist can be an antisense-oligonucleotide, siRNA, shRNA, miRNA, dsRNA, aptamer, PNA (peptide nucleic acid) targeting human TIM3, or a vector including the same. In some embodiments, the antagonist can be an antibody, or an antigen-binding portion thereof, that specifically binds to human TIM3 and suppress or inhibit human TIM3 activity.

The term "antibody" or "antibodies" refer, in certain embodiments, to a protein comprising at least two heavy (H) chains and two light (L) chains inter-connected by disulfide bonds. Each heavy chain is comprised of a heavy chain variable region (abbreviated herein as VH) and a heavy chain constant region (abbreviated herein as CH). In certain antibodies, e.g., naturally occurring IgG antibodies, the heavy chain constant region is comprised of a hinge and three domains, CH1, CH2 and CH3. In certain antibodies, e.g., naturally occurring IgG antibodies, each light chain is comprised of a light chain variable region (abbreviated herein as VL) and a light chain constant region. The light chain constant region is comprised of one domain (abbreviated herein as CL). The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (C1q) of the classical complement system. A heavy chain may have the C-terminal lysine or not. Unless specified otherwise herein, the amino acids in the variable regions are numbered using the Kabat numbering system and those in the constant regions are numbered using the EU system.

An "IgG antibody", e.g., a human IgG1, IgG2, IgG3 and IgG4 antibody, as used herein has, in certain embodiments, the structure of a naturally occurring IgG antibody, i.e., it has the same number of heavy and light chains and disulfide bonds as a naturally occurring IgG antibody of the same subclass. For example, an anti-TIM3 IgG1, IgG2, IgG3 or IgG4 antibody consists of two heavy chains (HCs) and two light chains (LCs), wherein the two heavy chains and light chains are linked by the same number and location of disulfide bridges that occur in naturally occurring IgG1, IgG2, IgG3 and IgG4 antibodies, respectively (unless the antibody has been mutated to modify the disulfide bridges).

An immunoglobulin can be from any of the commonly known isotypes, including but not limited to IgA, secretory IgA, IgG and IgM. The IgG isotype is divided in subclasses in certain species: IgG1, IgG2, IgG3 and IgG4 in humans, and IgG1, IgG2a, IgG2b and IgG3 in mice. In certain embodiments, the anti-TIM3 antibodies described herein are of the IgG1 subtype. Immunoglobulins, e.g., IgG1, exist in several allotypes, which differ from each other in at most a few amino acids. "Antibody" includes, by way of example, both naturally occurring and non-naturally occurring antibodies; monoclonal and polyclonal antibodies; chimeric and humanized antibodies; human and nonhuman antibodies and wholly synthetic antibodies.

The term "antigen-binding portion" of an antibody (also called an "antigen-binding fragment"), as used herein, refers to one or more fragments of an antibody that retain the ability to specifically bind to an antigen (e.g., human TIM3). It has been shown that the antigen-binding function of an antibody can be performed by fragments of a full-length antibody. Examples of binding fragments encompassed within the term "antigen-binding portion" of an antibody, e.g., an anti-TIM3 antibody described herein, include (i) a Fab fragment (fragment from papain cleavage) or a similar monovalent fragment consisting of the VL, VH, LC and CH1 domains; (ii) a F(ab')2 fragment (fragment from pepsin cleavage) or a similar bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., *Nature* 341:544-546 (1989)), which consists of a VH domain; (vi) an isolated complementarity determining region (CDR) and (vii) a combination of two or more isolated CDRs which can optionally be joined by a synthetic linker. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see e.g., Bird et al., *Science* 242:423-426 (1988); and Huston et al., *Proc. Natl. Acad. Sci. USA* 85:5879-5883 (1988)). Such single chain antibodies are also intended to be encompassed within the term "antigen-binding portion" of an antibody. These antibody fragments are obtained using conventional techniques known to those with skill in the art, and the fragments are screened for utility in the same manner as are intact antibodies. Antigen-binding portions can be produced by recombinant DNA techniques, or by enzymatic or chemical cleavage of intact immunoglobulins.

The term "monoclonal antibody," as used herein, refers to an antibody from a population of substantially homogeneous antibodies, i.e., the individual antibodies comprised in the population are substantially similar and bind the same epitope(s) (e.g., the antibodies display a single binding specificity and affinity), except for possible variants that may arise during production of the monoclonal antibody, such variants generally being present in minor amounts. The modifier "monoclonal" indicates the character of the antibody as being obtained from a substantially homogeneous population of antibodies, and is not to be construed as requiring production of the antibody by any particular method. The term "human monoclonal antibody" refers to an antibody from a population of substantially homogeneous antibodies that display(s) a single binding specificity and which has variable and optional constant regions derived from human germline immunoglobulin sequences. In some embodiments, human monoclonal antibodies are produced by a hybridoma which includes a B cell obtained from a transgenic non-human animal, e.g., a transgenic mouse, having a genome comprising a human heavy chain transgene and a light chain transgene fused to an immortalized cell.

The term "recombinant human antibody," as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom, (b) antibodies isolated from a host cell transformed to express the antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies comprise variable and constant regions that utilize particular human germline immunoglobulin sequences are encoded by the germline genes, but include subsequent rearrangements and mutations which occur, for example, during antibody maturation. As known in the art (see, e.g., Lonberg (2005) *Nature Biotech.* 23(9): 1117-1125), the variable region contains the antigen binding domain, which is encoded by various genes that rearrange to form an antibody specific for a foreign antigen. In addition to rearrangement, the variable region can be further modified by multiple single amino acid changes (referred to as somatic mutation or hypermutation) to increase the affinity of the antibody to the foreign antigen. The constant region will change in further response to an antigen (i.e., isotype switch). Therefore, the rearranged and somatically mutated nucleic acid molecules that encode the light chain and heavy chain immunoglobulin polypeptides in response to an antigen cannot have sequence identity with the original nucleic acid molecules, but instead will be substantially identical or similar (i.e., have at least 80% identity).

A "human" antibody (HuMAb) refers to an antibody having variable regions in which both the framework and CDR regions are derived from human germline immunoglobulin sequences. Furthermore, if the antibody contains a constant region, the constant region also is derived from human germline immunoglobulin sequences. The anti-TIM3 antibodies described herein can include amino acid residues not encoded by human germline immunoglobulin sequences (e.g., mutations introduced by random or site-specific mutagenesis in vitro or by somatic mutation in vivo). However, the term "human antibody", as used herein, is not intended to include antibodies in which CDR sequences derived from the germline of another mammalian species, such as a mouse, have been grafted onto human framework sequences. The terms "human" antibodies and "fully human" antibodies are used synonymously.

A "humanized" antibody refers to an antibody in which some, most or all of the amino acids outside the CDR domains of a non-human antibody are replaced with corresponding amino acids derived from human immunoglobulins. In some embodiments of a humanized form of an antibody, some, most or all of the amino acids outside the CDR domains have been replaced with amino acids from human immunoglobulins, whereas some, most or all amino acids within one or more CDR regions are unchanged. Small additions, deletions, insertions, substitutions or modifications of amino acids are permissible as long as they do not abrogate the ability of the antibody to bind to a particular antigen. A "humanized" antibody retains an antigenic specificity similar to that of the original antibody.

A "chimeric antibody" refers to an antibody in which the variable regions are derived from one species and the constant regions are derived from another species, such as an antibody in which the variable regions are derived from a mouse antibody and the constant regions are derived from a human antibody.

As used herein, "isotype" refers to the antibody class (e.g., IgG1, IgG2, IgG3, IgG4, IgM, IgA1, IgA2, IgD, and IgE antibody) that is encoded by the heavy chain constant region genes.

"Allotype" refers to naturally occurring variants within a specific isotype group, which variants differ in a few amino acids (see, e.g., Jefferis et al. (2009) *mAbs* 1:1). Anti-TIM3 antibodies described herein can be of any allotype. As used herein, antibodies referred to as "IgG1f," "IgG1.1f," or "IgG1.3f" isotype are IgG1, effectorless IgG1.1, and effectorless IgG1.3 antibodies, respectively, of the allotype "f," i.e., having 214R, 356E and 358M according to the EU index as in Kabat, as shown, e.g., in SEQ ID NO: 123.

The phrases "an antibody recognizing an antigen" and "an antibody specific for an antigen" are used interchangeably herein with the term "an antibody which binds specifically to an antigen."

An "isolated antibody," as used herein, is intended to refer to an antibody which is substantially free of other proteins and cellular material.

An "Fc receptor" or "FcR" is a receptor that binds to the Fc region of an immunoglobulin. FcRs that bind to an IgG antibody comprise receptors of the FcγR family, including allelic variants and alternatively spliced forms of these receptors. The FcγR family consists of three activating (FcγRI, FcγRIII, and FcγRIV in mice; FcγRIA, FcγRIIA, and FcγRIIIA in humans) and one inhibitory (FcγRIIB) receptor. Various properties of human FcγRs are known in the art. The majority of innate effector cell types coexpress one or more activating FcγR and the inhibitory FcγRIIB, whereas natural killer (NK) cells selectively express one activating Fc receptor (FcγRIII in mice and FcγRIIIA in humans) but not the inhibitory FcγRIIB in mice and humans. Human IgG1 binds to most human Fc receptors and is considered equivalent to murine IgG2a with respect to the types of activating Fc receptors that it binds to.

An "Fc region" (fragment crystallizable region) or "Fc domain" or "Fc" refers to the C-terminal region of the heavy chain of an antibody that mediates the binding of the immunoglobulin to host tissues or factors, including binding to Fc receptors located on various cells of the immune system (e.g., effector cells) or to the first component (C1q) of the classical complement system. Thus, an Fc region comprises the constant region of an antibody excluding the first constant region immunoglobulin domain (e.g., CH1 or CL). In IgG, IgA and IgD antibody isotypes, the Fc region comprises two identical protein fragments, derived from the second (CH2) and third (CH3) constant domains of the antibody's two heavy chains; IgM and IgE Fc regions comprise three heavy chain constant domains (CH domains 2-4) in each polypeptide chain. For IgG, the Fc region comprises immunoglobulin domains CH2 and CH3 and the hinge between CH1 and CH2 domains. Although the definition of the boundaries of the Fc region of an immunoglobulin heavy chain might vary, as defined herein, the human IgG heavy chain Fc region is defined to stretch from an amino acid residue D221 for IgG1, V222 for IgG2, L221 for IgG3 and P224 for IgG4 to the carboxy-terminus of the heavy chain, wherein the numbering is according to the EU index as in Kabat. The CH2 domain of a human IgG Fc region extends from amino acid 237 to amino acid 340, and the CH3 domain is positioned on C-terminal side of a CH2 domain in an Fc region, i.e., it extends from amino acid 341 to amino acid 447 or 446 (if the C-terminal lysine residue is absent) or 445 (if the C-terminal glycine and lysine residues are absent) of an IgG. As used herein, the Fc region can be a native sequence Fc, including any allotypic variant, or a variant Fc (e.g., a non-naturally occurring Fc). Fc can also refer to this region in isolation or in the context of an Fc-comprising protein polypeptide such as a "binding protein comprising an Fc region," also referred to as an "Fc fusion protein" (e.g., an antibody or immunoadhesion).

A "native sequence Fc region" or "native sequence Fc" comprises an amino acid sequence that is identical to the amino acid sequence of an Fc region found in nature. Native sequence human Fc regions include a native sequence human IgG1 Fc region; native sequence human IgG2 Fc region; native sequence human IgG3 Fc region; and native sequence human IgG4 Fc region as well as naturally occurring variants thereof. Native sequence Fc include the various allotypes of Fcs (see, e.g., Jefferis et al. (2009) *mAbs* 1: 1).

The term "naturally-occurring" as used herein as applied to an object refers to the fact that an object can be found in nature. For example, a polypeptide or polynucleotide sequence that is present in an organism (including viruses) that can be isolated from a source in nature and which has not been intentionally modified by man in the laboratory is naturally-occurring.

A "polypeptide" refers to a chain comprising at least two consecutively linked amino acid residues, with no upper limit on the length of the chain. One or more amino acid residues in the protein can contain a modification such as, but not limited to, glycosylation, phosphorylation or disulfide bond formation. A "protein" can comprise one or more polypeptides.

"Conservative amino acid substitutions" refer to substitutions of an amino acid residue with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). In certain embodiments, a predicted nonessential amino acid residue in an anti-TIM3 antibody is replaced with another amino acid residue from the same side chain family. Methods of identifying nucleotide and amino acid conservative substitutions which do not eliminate antigen binding are well-known in the art (see, e.g., Brummell et al., *Biochem.* 32: 1180-1187 (1993); Kobayashi et al., *Protein Eng.* 12(10):879-884 (1999); and Burks et al., *Proc. Natl. Acad. Sci. USA* 94:412-417 (1997)).

For polypeptides, the term "substantial homology" indicates that two polypeptides, or designated sequences thereof, when optimally aligned and compared, are identical, with appropriate amino acid insertions or deletions, in at least about 80% of the amino acids, at least about 90% to 95%, or at least about 98% to 99.5% of the amino acids.

The percent identity between two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The term "vector," as used herein, is intended to refer to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors") In general, expression vectors of utility in recombinant DNA techniques are often in the form of plasmids. In the present specification, "plasmid" and "vector" can be used interchangeably as the plasmid is the most commonly used form of vector. However, also included are other forms of expression vectors, such as viral vectors (e.g., replication defective retroviruses, adenoviruses and adeno-associated viruses), which serve equivalent functions.

An "immune response" is as understood in the art, and generally refers to a biological response within a vertebrate against foreign agents or abnormal, e.g., cancerous cells, which response protects the organism against these agents and diseases caused by them. An immune response is mediated by the action of one or more cells of the immune system (for example, a T lymphocyte, B lymphocyte, natural killer (NK) cell, macrophage, eosinophil, mast cell, dendritic cell or neutrophil) and soluble macromolecules produced by any of these cells or the liver (including antibodies, cytokines, and complement) that results in selective targeting, binding to, damage to, destruction of, and/or elimination from the vertebrate's body of invading pathogens, cells or tissues infected with pathogens, cancerous or other abnormal cells, or, in cases of autoimmunity or pathological inflammation, normal human cells or tissues. An immune reaction includes, e.g., activation or inhibition of a T cell, e.g., an effector T cell, a Th cell, a CD4+ cell, a CD8+ T cell, or a Treg cell, or activation or inhibition of any other cell of the immune system, e.g., NK cell.

An "immunomodulator" or "immunoregulator" refers to an agent, e.g., an agent targeting a component of a signaling pathway that can be involved in modulating, regulating, or modifying an immune response. "Modulating," "regulating," or "modifying" an immune response refers to any alteration in a cell of the immune system or in the activity of such cell (e.g., an effector T cell, such as a Th1 cell). Such modulation includes stimulation or suppression of the immune system which can be manifested by an increase or decrease in the number of various cell types, an increase or decrease in the activity of these cells, or any other changes which can occur within the immune system. Both inhibitory and stimulatory immunomodulators have been identified, some of which can have enhanced function in a tumor microenvironment. In some embodiments, the immunomodulator targets a molecule on the surface of a T cell. An "immunomodulatory target" or "immunoregulatory target" is a molecule, e.g., a cell surface molecule, that is targeted for binding by, and whose activity is altered by the binding of, a substance, agent, moiety, compound or molecule. Immunomodulatory targets include, for example, receptors on the surface of a cell ("immunomodulatory receptors") and receptor ligands ("immunomodulatory ligands").

"Immunotherapy" refers to the treatment of a subject afflicted with, or at risk of contracting or suffering a recurrence of, a disease by a method comprising inducing, enhancing, suppressing or otherwise modifying the immune system or an immune response.

"Immuno stimulating therapy" or "immuno stimulatory therapy" refers to a therapy that results in increasing (inducing or enhancing) an immune response in a subject for, e.g., treating cancer.

"T effector" ("Teff") cells refers to T cells (e.g., CD4+ and CD8+ T cells) with cytolytic activities as well as T helper (Th) cells, e.g., Th1 cells, which cells secrete cytokines and activate and direct other immune cells, but does not include regulatory T cells (Treg cells). Certain anti-TIM3 antibodies described herein activate Teff cells, e.g., CD4+ and CD8+ Teff cells and Th1 cells.

An increased ability to stimulate an immune response or the immune system, can result from an enhanced agonist activity of T cell co-stimulatory receptors and/or an enhanced antagonist activity of inhibitory receptors. An increased ability to stimulate an immune response or the immune system can be reflected by a fold increase of the EC50 or maximal level of activity in an assay that measures an immune response, e.g., an assay that measures changes in cytokine or chemokine release, cytolytic activity (determined directly on target cells or indirectly via detecting CD107a or granzymes) and proliferation. The ability to stimulate an immune response or the immune system activity can be enhanced by at least 10%, 30%, 50%, 75%, 2 fold, 3 fold, 5 fold or more.

As used herein, the term "linked" refers to the association of two or more molecules. The linkage can be covalent or non-covalent. The linkage also can be genetic (i.e., recombinantly fused). Such linkages can be achieved using a wide variety of art recognized techniques, such as chemical conjugation and recombinant protein production.

As used herein, "administering" refers to the physical introduction of a composition comprising a therapeutic agent to a subject, using any of the various methods and delivery systems known to those skilled in the art. Different routes of administration for the anti-TIM3 antibodies described herein include intravenous, intraperitoneal, intramuscular, subcutaneous, spinal or other parenteral routes of administration, for example by injection or infusion. The phrase "parenteral administration" as used herein means modes of administration other than enteral and topical administration, usually by injection, and includes, without limitation, intravenous, intraperitoneal, intramuscular, intraarterial, intrathecal, intralymphatic, intralesional, intracapsular, intraorbital, intracardiac, intradermal, transtracheal, subcutaneous, subcuticular, intraarticular, subcapsular, subarachnoid, intraspinal, epidural and intrasternal injection and infusion, as well as in vivo electroporation. Alternatively, an antibody described herein can be administered via a non-parenteral route, such as a topical, epidermal or mucosal route of administration, for example, intranasally, orally, vaginally, rectally, sublingually or topically. Administering can also be performed, for example, once, a plurality of times, and/or over one or more extended periods.

As used herein, the term "T cell-mediated response" refers to a response mediated by T cells, including effector T cells (e.g., CD8+ cells) and helper T cells (e.g., CD4+ cells). T cell mediated responses include, for example, T cell cytotoxicity and proliferation.

As used herein, the term "cytotoxic T lymphocyte (CTL) response" refers to an immune response induced by cytotoxic T cells. CTL responses are mediated primarily by CD8+ T cells.

As used herein, the terms "inhibits" or "blocks" (e.g., referring to inhibition/blocking of binding of a TIM3 ligand ("TIM3-L") to TIM3 on cells) are used interchangeably and encompass both partial and complete inhibition/blocking. In some embodiments, an anti-TIM3 antibody inhibits binding of TIM3-L to TIM3 by at least about 50%, for example, about 60%, 70%, 80%, 90%, 95%, 99%, or 100%, determined, e.g., as further described herein. In some embodiments, an anti-TIM3 antibody inhibits binding of TIM3-L to TIM3 by no more than 50%, for example, by about 40%, 30%, 20%, 10%, 5% or 1%, determined, e.g., as further described herein.

As used herein, the phrase "inhibits growth of a tumor" includes any measurable decrease in the growth of a tumor, e.g., the inhibition of growth of a tumor by at least about 10%, for example, at least about 20%, at least about 30%, at least about 40%, at least about 50%, at least about 60%, at least about 70%, at least about 80%, at least about 90%, at least about 99%, or 100%.

As used herein, "cancer" refers a broad group of diseases characterized by the uncontrolled growth of abnormal cells in the body. Unregulated cell division can result in the formation of malignant tumors or cells that invade neighboring tissues and can metastasize to distant parts of the body through the lymphatic system or bloodstream. A "cancer" or "cancer tissue" can include a tumor.

The term "tumor" as used herein refers to any mass of tissue that results from excessive cell growth or proliferation, either benign (non-cancerous) or malignant (cancerous), including pre-cancerous lesions.

A "tumor-infiltrating inflammatory cell" is any type of cell that typically participates in an inflammatory response in a subject and which infiltrates tumor tissue. Such cells include tumor-infiltrating lymphocytes (TILs), macrophages, monocytes, eosinophils, histiocytes, and dendritic cells.

"TILs" or "tumor infiltrating lymphocytes," as used herein, refers to tumor infiltrating lymphocytes and other non-lymphocytic mononuclear immune cells.

A cancer patient "responding to a treatment with a TIM3 antagonist" refers to a patient who shows an improvement in the cancer, as evidenced by the size of tumors (e.g., smaller tumor size or no tumor after the treatment), growth rate of tumors (e.g., slower growth or stopped growth after the treatment), number of tumor cells (e.g., reduced number of tumor cells after the treatment), activity of the immune system (e.g., higher activity against foreign antigens and/or reduced T cell exhaustion), or any combination thereof.

The terms "treat," "treating," and "treatment," as used herein, refer to any type of intervention or process performed on, or administering an active agent to, the subject with the objective of reversing, alleviating, ameliorating, inhibiting, or slowing down or preventing the progression, development, severity or recurrence of a symptom, complication, condition or biochemical indicia associated with a disease or enhancing overall survival. Treatment can be of a subject having a disease or a subject who does not have a disease (e.g., for prophylaxis).

"Programmed Death-1 (PD-1)" refers to an immunoinhibitory receptor belonging to the CD28 family. PD-1 is expressed predominantly on previously activated T cells in vivo, and binds to two ligands, PD-L1 and PD-L2. The term "PD-1" as used herein includes human PD-1 (hPD-1), variants, isoforms, and species homologs of hPD-1, and analogs having at least one common epitope with hPD-1. The complete hPD-1 sequence can be found under GenBank Accession No. U64863.

"Programmed Death Ligand-1 (PD-L1)" is one of two cell surface glycoprotein ligands for PD-1 (the other being PD-L2) that downregulate T cell activation and cytokine secretion upon binding to PD-1. The term "PD-L1" as used herein includes human PD-L1 (hPD-L1), variants, isoforms, and species homologs of hPD-L1, and analogs having at least one common epitope with hPD-L1. The complete hPD-L1 sequence can be found under GenBank Accession No. Q9NZQ7.

The term "PD-1/PD-L1 axis antagonist" as used herein is an agent that inhibits the interaction between PD-1 and PD-L1. As used herein, a PD-1/PD-L1 axis binding antagonist includes a PD-1 binding antagonist and a PD-L1 binding antagonist.

The terms "effector memory TILs" and "effector memory T cells" refer to T lymphocytes that are characterized as CCR7− CD45RO+ in the present disclosure.

The terms "central memory TILs" and "central memory T cells" refer to T lymphocytes that are characterized as CCR7+ CD45RO+ in the present disclosure.

The terms "naïve TILs" and "naïve T cells" refer to T lymphocytes that are characterized as CCR7+ CD45RO− in the present disclosure.

The terms "effector TILs" and "effector T cells" refer to T lymphocytes that are characterized as CCR7− CD45RO− in the present disclosure.

A "hematological malignancy" includes a lymphoma, leukemia, myeloma or a lymphoid malignancy, as well as a cancer of the spleen and the lymph nodes. Exemplary lymphomas include both B cell lymphomas (a B-cell hematological cancer) and T cell lymphomas. B-cell lymphomas include both Hodgkin's lymphomas and most non-Hodgkin's lymphomas. Non-limiting examples of B cell lymphomas include diffuse large B-cell lymphoma, follicular lymphoma, mucosa-associated lymphatic tissue lymphoma, small cell lymphocytic lymphoma (overlaps with chronic lymphocytic leukemia), mantle cell lymphoma (MCL), Burkitt's lymphoma, mediastinal large B cell lymphoma, Waldenstrom macroglobulinemia, nodal marginal zone B cell lymphoma, splenic marginal zone lymphoma, intravascular large B-cell lymphoma, primary effusion lymphoma, lymphomatoid granulomatosis. Non-limiting examples of T cell lymphomas include extranodal T cell lymphoma, cutaneous T cell lymphomas, anaplastic large cell lymphoma, and angioimmunoblastic T cell lymphoma. Hematological malignancies also include leukemia, such as, but not limited to, secondary leukemia, chronic lymphocytic leukemia, acute myelogenous leukemia, chronic myelogenous leukemia, and acute lymphoblastic leukemia. Hematological malignancies further include myelomas, such as, but not limited to, multiple myeloma and smoldering multiple myeloma. Other hematological and/or B cell- or T-cell-associated cancers are encompassed by the term hematological malignancy.

The term "effective dose" or "effective dosage" is defined as an amount sufficient to achieve or at least partially achieve a desired effect. A "therapeutically effective amount" or "therapeutically effective dosage" of a drug or therapeutic agent is any amount of the drug that, when used alone or in combination with another therapeutic agent, promotes disease regression evidenced by a decrease in severity of disease symptoms, an increase in frequency and duration of disease symptom-free periods, or a prevention of impairment or disability due to the disease affliction. A therapeutically effective amount or dosage of a drug includes a "prophylactically effective amount" or a "prophylactically effective dosage", which is any amount of the drug that, when administered alone or in combination with another therapeutic agent to a subject at risk of developing a disease or of suffering a recurrence of disease, inhibits the development or recurrence of the disease. The ability of a therapeutic agent to promote disease regression or inhibit the development or recurrence of the disease can be evaluated using a variety of methods known to the skilled practitioner, such as in human subjects during clinical trials, in animal model systems predictive of efficacy in humans, or by assaying the activity of the agent in in vitro assays.

By way of example, an anti-cancer agent is a drug that promotes cancer regression in a subject. In some embodiments, a therapeutically effective amount of the drug promotes cancer regression to the point of eliminating the cancer. "Promoting cancer regression" means that administering an effective amount of the drug, alone or in combination with an antineoplastic agent, results in a reduction in tumor growth or size, necrosis of the tumor, a decrease in severity of at least one disease symptom, an increase in frequency and duration of disease symptom-free periods, a prevention of impairment or disability due to the disease affliction, or otherwise amelioration of disease symptoms in the patient. In addition, the terms "effective" and "effectiveness" with regard to a treatment includes both pharmacological effectiveness and physiological safety. Pharmacological effectiveness refers to the ability of the drug to promote cancer regression in the patient. Physiological safety refers to the level of toxicity, or other adverse physiological effects at the cellular, organ and/or organism level (adverse effects) resulting from administration of the drug.

By way of example for the treatment of tumors, a therapeutically effective amount or dosage of the drug inhibits cell growth or tumor growth by at least about 20%, by at least about 40%, by at least about 60%, or by at least about 80% relative to untreated subjects. In some embodiments, a therapeutically effective amount or dosage of the drug completely inhibits cell growth or tumor growth, i.e., inhibits cell growth or tumor growth by 100%. The ability of a compound to inhibit tumor growth can be evaluated using the assays described infra. Alternatively, this property of a composition can be evaluated by examining the ability of the compound to inhibit cell growth, such inhibition can be measured in vitro by assays known to the skilled practitioner. In other embodiments described herein, tumor regression can be observed and continue for a period of at least about 20 days, at least about 40 days, or at least about 60 days.

The term "patient" refers to a human (or human subject).

As used herein, the term "subject" refers to a human subject. A subject can be a subject having cancer.

The term "weight based" dose or dosing as referred to herein means that a dose that is administered to a patient is calculated based on the weight of the patient. For example, when a patient with 60 kg body weight requires 3 mg/kg of an anti-TIM3 antibody, one can calculate and use the appropriate amount of the anti-TIM3 antibody (i.e., 180 mg) for administration.

The use of the term "fixed dose" with regard to a method of the disclosure means that two or more different antibodies in a single composition (e.g., anti-TIM3 antibody and a second antibody, e.g., a PD-1 or PD-L1 antibody) are present in the composition in particular (fixed) ratios with each other. In some embodiments, the fixed dose is based on the weight (e.g., mg) of the antibodies. In certain embodiments, the fixed dose is based on the concentration (e.g., mg/ml) of the antibodies. In some embodiments, the ratio of the two antibodies (e.g., anti-TIM3 and anti-PD1 or anti-PD-L1) is at least about 1:1, about 1:2, about 1:3, about 1:4, about 1:5, about 1:6, about 1:7, about 1:8, about 1:9, about 1:10, about 1:15, about 1:20, about 1:30, about 1:40, about 1:50, about 1:60, about 1:70, about 1:80, about 1:90, about 1:100, about 1:120, about 1:140, about 1:160, about 1:180, about 1:200, about 200:1, about 180:1, about 160:1, about 140:1, about 120:1, about 100:1, about 90:1, about 80:1, about 70:1, about 60:1, about 50:1, about 40:1, about 30:1, about 20:1, about 15:1, about 10:1, about 9:1, about 8:1, about 7:1, about 6:1, about 5:1, about 4:1, about 3:1, or about 2:1 mg first antibody (e.g., anti-TIM3 antibody) to mg second antibody. For example, a 2:1 ratio of an anti-TIM3 antibody and a PD-1 antibody, such as nivolumab, can mean that a vial or an injection can contain about 480 mg of the anti-TIM3 antibody and 240 mg of the anti-PD-1 antibody, or about 2 mg/ml of the anti-TIM3 antibody and 1 mg/ml of the anti-PD-1 antibody.

The use of the term "flat dose" with regard to the methods and dosages described herein means a dose that is administered to a patient without regard for the weight or body surface area (BSA) of the patient. The flat dose is therefore not provided as a mg/kg dose, but rather as an absolute amount of the agent (e.g., the anti-TIM3 antibody). For example, a 60 kg person and a 100 kg person would receive the same dose of an antibody (e.g., 480 mg of an anti-TIM3 antibody).

As used herein, the terms "ug" and "uM" are used interchangeably with "µg" and "µM," respectively.

Various aspects described herein are described in further detail in the following subsections.

METHODS OF THE PRESENT DISCLOSURE

The present disclosure is directed to methods of identifying a subject (e.g., human cancer patient) suitable for treatment with an anti-TIM3 antagonist (e.g., anti-TIM3 antibody) alone or in conjunction with another immune checkpoint inhibitor (e.g., an anti-PD-1 antibody).

In some embodiments, the methods disclosed herein comprise measuring or determining the concentration of soluble TIM3 in the serum ("serum TIM3 concentration") of a subject and comparing the concentration to the serum TIM3 concentration of a control subject (e.g., healthy patient). If the serum TIM3 concentration of the subject is higher than that of the control subject, then the subject is likely to respond to a treatment with an anti-TIM3 antagonist. In some embodiments, the subject who is likely to respond to a treatment with an anti-TIM3 antagonist has serum TIM3 concentration that is at least 10% higher than the concentration observed in the control subject. In other embodiments, the subject's serum TIM3 concentration is at least 20%, 30%, 40%, 50%, 60%, 70%, 80%, 90%, or 100% (2-fold) higher than that of the control subject. In other embodiments, the subject's serum TIM3 concentration is at least 2500 pg/mL or at least 3000 pg/mL.

In some embodiments, the methods disclosed herein comprise measuring or determining the percentage of tumor infiltrating lymphocytes (TILs) in the subject that are TIM3 positive. In other embodiments, if at least 10%, 20%, 30%, 40%, 50%, 60%, or 70% of the TILs in the subject are TIM3 positive, the subject is likely to respond to a treatment with a TIM3 antagonist. In certain embodiments, the methods disclosed herein comprise measuring or determining the percentage of $CD8^+$ tumor infiltrating lymphocytes (TILs) in the subject that are TIM3 positive. In some embodiments, if at least 10%, 20%, 30%, 40%, 50%, 60%, or 70% of the $CD8^+$ TILs in the subject are TIM3 positive, the subject is likely to respond to a treatment with a TIM3 antagonist. In certain embodiments, the methods disclosed herein comprise measuring or determining the percentage of $CD4^+$ tumor infiltrating lymphocytes (TILs) in the subject that are TIM3 positive. In some embodiments, if at least 10%, 20%, 30%, 40%, 50%, 60%, or 70% of the $CD4^+$ TILs in the subject are TIM3 positive, the subject is likely to respond to a treatment with a TIM3 antagonist. In some embodiments, the methods disclosed herein comprise measuring or determining the percentage of $CD4^+$ and $CD8^+$ tumor infiltrating lymphocytes (TILs) in the subject that are TIM3 positive. In other embodiments, if at least 10%, 20%, 30%, 40%, 50%, 60%, or 70% of the $CD4^+$ and/or $CD8^+$ TILs in the subject are TIM3 positive, the subject is likely to respond to a treatment with a TIM3 antagonist.

In some embodiments, the method comprises measuring or determining the percentage of naïve (CCR7+ CD45RO−), central memory (CM) (CCR7+ CD45RO+), effector memory (EM) (CCR7− CDRO+), and effector (Teff) (CCR7− CD45RO−) TILs that are TIM3 positive. If the percentage of TIM3 positive EM and/or Teff TILs is higher than the percentage of TIM3 positive naïve or CM TILs, then the subject is likely to respond to a treatment with a TIM3 antagonist. In some embodiment, the TILs are CD4+ TILs. In other embodiments, the TILs are CD8+ TILs.

In some embodiments, the methods disclosed herein allow to identify a subject (e.g., human cancer patient) suitable for treatment with a combination of TIM3 antagonist and PD-1 antagonist. Such subject can be identified by measuring or determining the percentage of tumor infiltrating lymphocytes (TILs) in the subject that are PD-1 positive and TIM3 positive, wherein if at least 5% of the TILs are positive for both PD-1 and TIM3, the subject is likely to respond to a treatment comprising both TIM3 antagonist and PD-1 antagonist. In some embodiments, a co-expression of both PD-1 and TIM3 on at least 10%, 20%, 30%, or 40% of the TILs indicates that the subject is likely to respond to a treatment comprising both TIM-3 antagonist and PD-1 antagonist. In some embodiment, the TILs are CD4+ TILs. In other embodiments, the TILs are CD8+ TILs. In certain embodiments, if at least 5%, 10%, 20%, 30%, or 40% of both CD4+ and CD8+ TILs are positive for both PD-1 and TIM3, the subject is likely to respond to a treatment comprising both TIM3 antagonist and PD-1 antagonist.

The present disclosure also provides methods of treating a subject (e.g., a human cancer patient) suitable for treatment with a TIM3 antagonist (e.g., anti-TIM3 antibody) comprising administering to the subject a therapeutically effective amount of TIM3 antagonist. A suitable subject for treatment with a TIM3 antagonist may be identified by any of the methods described above. The subject may be suitable for treatment with a TIM3 antagonist, alone or in conjunction with another immune checkpoint inhibitor (e.g., an anti-PD-1 antibody).

In some embodiments, the concentration of soluble TIM3 in the serum ("serum TIM3 concentration") of the subject suitable for treatment with a TIM3 antagonist is higher than the concentration of soluble TIM3 observed in the serum of a control subject (e.g., healthy patient). In some embodiments, the subject's serum TIM3 concentration is at least 10% higher than that observed in the control subject. In other embodiments, the subject's serum TIM3 concentration is at least 20%, 30%, 40%, 50%, 60%, 70%, 80%, 90%, or 100% (2-fold) higher than that of the control subject. In certain embodiments, the subject's serum TIM3 concentration is at least 2500 pg/mL or at least 3000 pg/mL. In some embodiments, the serum TIM3 concentration of the subject is measured or determined prior to administering, and if the subject's serum TIM3 concentration is higher than that of the control subject, the subject is administered with a therapeutically effective amount of a TIM3 antagonist.

In some embodiments, the subject suitable for treatment with a TIM3 antagonist has CD8+ TILs that are at least 10%, 20%, 30%, 40%, 50%, 60%, or 70% TIM3 positive. In some embodiment, the percentage of TIM3 positive CD8+ TILs is determined prior to administering, and if the percentage is higher than 10%, 20%, 30%, 40%, 50%, 60% or 70% of the total CD8+ TILs, then the subject is administered with a therapeutically effective amount of a TIM3 antagonist.

In some embodiments, the subject suitable for treatment with a TIM3 antagonist can be identified by measuring or determining the percentage of naïve, central memory (CM), effector memory (EM), and effector (Teff) TILs that are TIM3 positive. If the percentage of TIM3 positive EM and/or Teff TILs are higher than the percentage of TIM3 positive naïve or CM TILs, then the subject is administered with a therapeutically effective amount of TIM3 antagonist. In some embodiment, the TILs are CD4+ TILs. In other embodiments, the TILs are CD8+ TILs. In certain embodiments, the percentages of TIM3 positive naïve, CM, EM, Teff TILs are determined prior to administering, and if the percentage of TIM3 positive EM and/or Teff TILs is higher than that of naïve and/or CM TILs, then the subject is administered with a therapeutically effective amount of TIM3 antagonist.

Also provided herein are methods of treating a subject suitable for treatment with a combination of TIM3 antagonist and PD-1 antagonist, comprising administering to such subject a therapeutically effective amount of a combination of PD-1 antagonist and TIM3 antagonist. In one embodiment, the combination of PD1 antagonist and TIM3 antagonist is administered to the subject if at least 5% of the subject's CD8+ TILs are positive for both PD1 and TIM3 expression. In some embodiments, the percentage of CD8+ TILs that express both PD-1 and TIM3 in the subject is at least 10%, 20%, 30%, 40%, 50%, 60%, or 70%. In a specific embodiment, the percentage of CD8+ TILs in the subject that express both PD-1 and TIM3 is determined prior to administering the combination of PD-1 antagonist and TIM3 antagonist.

In one embodiment, the combination of a TIM3 antagonist and a PD-1 antagonist is administered to the subject if at least 5% of the subject's CD4+ TILs are positive for both PD-1 and TIM3 expression. In some embodiments, the percentage of CD4+ TILs that express both PD-1 and TIM3 in the subject is at least 10%, 20%, 30%, 40%, 50%, 60%, or 70%. In certain embodiments, the percentage of CD4+ TILs in the subject that express both PD-1 and TIM3 is determined prior to administering the combination of PD-1 antagonist and TIM3 antagonist.

In some embodiments, the combination of a TIM3 antagonist and a PD-1 antagonist is administered to the subject if at least 5% of the subject's CD8+ and CD4+ TILs are positive for both PD-1 and TIM3 expression. In some embodiments, the percentage of CD8+ and CD4+ TILs that express both PD-1 and TIM3 in the subject is at least 10%, 20%, 30%, 40%, 50%, 60%, or 70%. In certain embodiments, the percentage of CD4+ and CD8+ TILs in the subject that express both PD-1 and TIM3 is determined prior to administering the combination of PD-1 antagonist and TIM3 antagonist.

In some embodiments, a TIM3 antagonist is administered with a therapeutically effective amount of a PD-1 antagonist (e.g., anti-PD-1 antibody or anti-PD-L1 antibody). In some embodiments, a PD-1 antagonist (e.g., anti-PD-1 antibody or anti-PD-L1 antibody) is administered at a flat dose ranging from about 80 mg to about 1280 mg or a weight-based dose ranging from about 1 mg/kg to about 12 mg/kg.

In some embodiments, a PD-1 antagonist (e.g., anti-PD-1 antibody or anti-PD-L1 antibody) used with a TIM3 antagonist in combination is administered at a flat dose of about 100 mg, about 200 mg, about 300 mg, about 400 mg, about 500 mg, about 600 mg, about 700 mg, about 800 mg, about 900 mg, about 1000 mg, about 1100 mg, or about 1200 mg.

In some embodiments, a PD-1 antagonist (e.g., anti-PD-1 antibody or anti-PD-L1 antibody) used with a TIM3 antagonist in combination is administered at a weight-based dose of about 1 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg, about 11 mg/kg, or about 12 mg/kg.

In some embodiments, a PD-1 antagonist (e.g., anti-PD-1 antibody or anti-PD-L1 antibody) for combination therapy with a TIM3 antagonist (e.g., anti-TIM3 antibody) is administered at a dosing interval of about 1 week, about 2 weeks, about 3 weeks, about 4 weeks, about 5 weeks, or about 6 weeks. In some embodiments, the dosing interval for a PD-1 antagonist (e.g., anti-PD-1 antibody or anti-PD-L1 antibody) is about 2 weeks. In some embodiments, the dosing interval for PD-1 antagonist (e.g., anti-PD-1 antibody or anti-PD-L1 antibody) is about 3 weeks. In some embodiments, the dosing interval for a PD-1 antagonist (e.g., anti-PD-1 antibody or anti-PD-L1 antibody) is about 4 weeks.

In some embodiments, a PD-1 antagonist is administered at a weight-based dose of about 10 mg/kg about every 2 weeks. In some embodiments, a PD-1 antagonist is administered at a flat dose of about 240 mg about every 2 weeks. In some embodiments, a PD-1 antagonist is administered at a flat dose of about 480 mg about every 4 weeks. In some embodiments, a PD-1 antagonist is administered at a weight based dose of about 2 mg/kg about every 3 weeks. In some embodiments, a PD-1 antagonist is administered at a flat dose of about 1200 mg about every 3 weeks. In some embodiments, a PD-1 antagonist is administered at a flat dose of about 200 mg about every 3 weeks.

The present disclosure further provides methods of assessing the efficacy of a treatment comprising a TIM3 antagonist in a subject in need thereof (e.g., human cancer patient), the method comprising determining or measuring the serum titer of soluble TIM3 in the subject, wherein the serum titer of soluble TIM3 in the subject is indicative of the subject's response to the treatment (e.g., disease normalization, e.g., restoration of immune surveillance). In one embodiment, a normal serum titer of soluble TIM3 (e.g., comparable to levels observed in a control subject, e.g., healthy patient) indicates that the treatment is efficacious in the subject. In certain embodiments, a serum titer of soluble TIM3 that is between that in the subject before treatment and a normal serum titer of soluble TIM3 (e.g., comparable to levels observed in a control subject, e.g., healthy patient) indicates that the treatment is efficacious in the subject.

The present disclosure provides methods of assessing the efficacy of a treatment comprising a TIM3 antagonist in a subject in need thereof (e.g., human cancer patient), the method comprising determining or measuring the serum titer of soluble TIM3 in the subject, wherein the serum titer of soluble TIM3 in the subject is indicative of the subject's response to the treatment. In some embodiments, a first dose of a TIIM3 antagonist is administered to a subject having cancer, and the level of soluble TIM3 is measured in the peripheral blood of the subject, wherein a decrease in the level of soluble TIM3 indicates that the subject responds to the TIM3 antagonist, and that further doses can be administered to the subject. In certain embodiments, 2 or more doses of a TIIM3 antagonist is administered to a subject having cancer, and the level of soluble TIM3 is measured in the peripheral blood of the subject, wherein a decrease in the level of soluble TIM3 indicates that the subject responds to the TIM3 antagonist, and that further doses can be administered to the subject. In certain embodiments, 1, 2 or more doses of a TIM3 antagonist is administered to a subject having cancer, and the level of soluble TIM3 is measured in the peripheral blood of the subject at different times, wherein the dose of TIM3 administered to the subject is adjusted based on the level of reduction of soluble TIM3 in the peripheral blood of the subject. For example, a higher dose may be administered if the level of soluble TIM3 has not significantly decreased following administration of a given dose of the TIM3 antagonist. Thus, generally, soluble TIM3 blood levels can be used as a predictive or stratification marker for subjects to be treated with a TIM3 antagonist. A decrease in soluble TIM3 that indicates that further treatment with a TIM3 antagonist is warranted may be a decrease of at least 5%, 10%, 20%, 25%, 30%, 50%, 75%, 90% or 100% of soluble TIM3. In certain embodiments, a decrease in soluble TIM3 that indicates that further treatment with a TIM3 antagonist is warranted is a decrease of at least 5%, 10%, 20%, 25%, 30%, 50%, 75%, 90% or 100% of soluble TIM3 isoform. In certain embodiments, a decrease in soluble TIM3 that indicates that further treatment with a TIM3 antagonist is warranted is a decrease of at least 5%, 10%, 20%, 25%, 30%, 50%, 75%, 90% or 100% of TIM3 shed from the cell surface. In certain embodiments, a decrease in soluble TIM3 that indicates that further treatment with a TIM3 antagonist is warranted is a decrease of at least 5%, 10%, 20%, 25%, 30%, 50%, 75%, 90% or 100% of soluble TIM3 isoform and/or TIM3 shed from the cell surface (in any ratio).

In some embodiments, an efficacious treatment treats the cancer (e.g., reduces or maintains tumor size) and/or reduces or alleviates the symptoms associated with the cancer. In certain embodiments, an efficacious treatment reduces tumor size by at least about 10%, about 20%, about 30%, about 40%, or about 50% compared to the tumor size prior to the treatment.

In some embodiments, an efficacious treatment effectively increases the duration of survival of the subject, e.g., the overall survival of the subject. In certain embodiments, an efficacious treatment increases the overall survival of the subject by at least about 6 months, at least about 7 months, at least about 8 months, at least about 9 months, at least about 10 months, at least about 11 months, at least about 12 months, at least about 13 months, at least about 14 months, at least about 15 months, at least about 16 months, at least about 17 months, at least about 18 months, at least about 19 months, at least about 20 months, at least about 21 months, at least about 22 months, at least about 23 months, at least about 24 months, at least about 25 months, at least about 26 months, at least about 27 months, at least about 28 months, at least about 29 months, at least about 30 months, at least about 3 years, at least about 3.5 years, at least about 4 years, at least about 4.5 years, at least about 5 years, or at least about 10 years.

In some embodiments, an efficacious treatment increases the duration of progression-free survival of the subject. In some embodiments, an efficacious treatment increases the duration of progression-free survival of the subject by at least about 1 month, at least about 2 months, at least about 3 months, at least about 4 months, at least about 5 months, at least about 6 months, at least about 7 months, at least about 8 months, at least about 9 months, at least about 10 months, at least about 11 months, at least about 1 year, at least about 15 months, at least about 18 months, at least about 2 years, at least about 3 years, at least about 4 years, or at least about 5 years.

In other embodiments, the frequencies of TIM3+ myeloid or TIM3+ NK cell subsets, e.g., in TILs, is determined. For example, the frequencies of TIM3+ cells can be determined in pDC, mDC, or CD14+ myeloid cells or in CD16−CD56+ or CD16+CD56+ NK cells in a subject having cancer, wherein the frequencies of TIM3+ cells in one or more of these types of cells is predictive of a response to a TIM-3 antagonist.

Measurement of TIM3 Expression and Frequency of TIM3 Positive Cells Among Populations of Cells The present disclosure provides methods for identifying a subject (e.g., human cancer patient) suitable for treatment with a TIM3 antagonist, alone or in combination with another immune checkpoint inhibitor (e.g., a PD-1 antagonist), comprising measuring or determining the TIM3 expression in a tissue sample obtained from the subject. The methods of measuring or determining the TIM3 expression can be achieved any of the methods described herein or known in the art.

In some embodiments, a tissue sample obtained from the subject includes, but is not limited to, any clinically relevant tissue sample, such as a tumor biopsy, a core biopsy tissue sample, a fine needle aspirate, or a sample of a bodily fluid, such as blood, plasma, serum, lymph, ascites fluid, cystic fluid, or urine. In some embodiments, the tissue sample is from a metastasis. In some embodiments, tissue samples are taken from a subject at multiple time points, for example, before treatment, during treatment, and/or after treatment. In some embodiments, tissue samples are taken from different locations in the subject, for example, a sample from a primary tumor and a sample from a metastasis in a distant location.

In some embodiments, the determination of TIM3 expression can be achieved without obtaining a tissue sample from the subject. In some embodiments, identifying a suitable subject for treatment with a TIM3 antagonist, comprises (i) optionally providing a tissue sample obtained from a subject, wherein the tissue sample comprises tumor cells and/or tumor-infiltrating inflammatory cells (e.g., TILs); and (ii) measuring or determining the percentage of cells in the tissue sample that express TIM3 in view of the levels expressed in a control subject (e.g., healthy patient).

In any of the methods described herein comprising determining or measuring TIM3 expression in a tissue sample, it should be understood that the step comprising obtaining the tissue sample from the patient is an optional step. That is, in certain embodiments, the method includes this step, while in other embodiments, this step is not included. It should also be understood that in certain embodiments, the step of measuring or determining TIM3 expression is performed by a transformative method of assaying for TIM3 expression (e.g., flow cytometry). In other embodiments, no transformative step is involved and the TIM3 expression is determined by, for example, reviewing a report of test results from a laboratory. In certain embodiments, the steps of the methods up to, and including, determining or measuring TIM3 expression result provide an intermediate result that may be provided to a physician or other healthcare provider for use in selecting a suitable candidate for treatment with a TIM3 antagonist, alone or in conjunction with another immune checkpoint inhibitor (e.g., TIM3 antagonist). In certain embodiments, the step that provides the intermediate result is performed by a medical practitioner or someone acting under the direction of a medical practitioner. In other embodiments, these steps are performed by an independent laboratory or by an independent person such as a laboratory technician.

In some embodiments, the proportion of cells that express TIM3 is assessed by performing an assay to detect the presence of TIM3 RNA. In further embodiments, the presence of TIM3 RNA is detected by RT-PCR, in situ hybridization or RNase protection. In some embodiments, the presence of TIM3 RNA is detected by an RT-PCR based assay. In other embodiments, scoring the RT-PCR based assay comprises measuring or determining the level of TIM3 RNA expression in the tissue sample relative to a predetermined level (e.g., observed in a control subject).

In some embodiments, the proportion of cells that express TIM3 is assessed by performing an assay to detect the presence of TIM3 protein. In further embodiments, the presence of TIM3 polypeptide is detected by IHC (immunohistochemistry), enzyme-linked immunosorbent assay (ELISA), in vivo imaging, or flow cytometry. In some embodiments, TIM3 expression is assayed by IHC. In other embodiments, cell surface expression of TIM3 is assayed using, e.g., IHC or in vivo imaging.

In some embodiments, the proportion (or frequency) of cells that express TIM3 in the tissue sample is assessed by flow cytometry. In some embodiments, the issue sample assayed by flow cytometry comprises tumor infiltrating immune cells (e.g., TILs). In some embodiments the tissue sample assayed by flow cytometry comprises peripheral blood cells. In some embodiments, the flow cytometry is a multiplex assay. In some embodiments, scoring the flow cytometry comprises detecting the expression of markers comprising TIM3, CD4, CD8, CCR7, CD45RO, and any combination thereof. In some embodiments, scoring the flow cytometry comprises assessing the proportion of CD4+ and CD8+ T cells in the tissue sample that express TIM3. In some embodiments, scoring the flow cytometry comprises assessing the proportion of CD8+ and CD4+ T cells in the tissue sample that express TIM3 and are (i) CCR7+ CD45RO− ("naïve T cells"), (ii) CCR7− CD45RO− ("Teff cells"), (iii) CCR7+ CD45RO+ ("CM cells"), or (iv) CCR7− CD45RO+ ("EM cells").

In some embodiments, soluble TIM3 is measured in the peripheral blood of subjects. Any agent that binds to soluble TIM3 (e.g., an agent that binds to the extracellular domain of human TIM3, such as further described in the Examples) can be used to determine level of soluble TIM3. In some embodiments, the level of both soluble TIM3 isoform and TIM3 shed from TIM3 positive cells is measured. In some embodiments, the level of either one of these forms of soluble TIM3 are measured. In some embodiments, the level of each of these forms of soluble TIM3 is separately measured.

Measurement of PD-1 Expression and Frequency of PD1 Positive Cells Among Populations of Cells In certain embodiments, identifying a subject (e.g., human cancer patient) suitable for a treatment comprising both a TIM3 antagonist and a PD-1 antagonist includes measuring or determining the PD-1 expression in a tissue sample obtained from the subject. The methods of measuring or determining the PD-1 expression can be achieved by any of the methods described herein or known in the art.

In some embodiments, a tissue sample obtained from the subject includes, but is not limited to, any clinically relevant tissue sample comprising CD4+ and/or CD8+ T cells, such as a tumor biopsy, a core biopsy tissue sample, a fine needle aspirate, or a sample of a bodily fluid, such as blood, plasma, serum, lymph, ascites fluid, cystic fluid, or urine. In some embodiments, the tissue sample is from a metastasis. In certain embodiments, tissue samples are taken from a subject at multiple time points, for example, before treatment, during treatment, and/or after treatment. In other embodiments, tissue samples are taken from different locations in the subject, for example, a sample from a primary tumor and a sample from a metastasis in a distant location.

In some embodiments, the determination of PD-1 expression can be achieved without obtaining a tissue sample from the subject. In some embodiments, identifying a suitable subject for treatment with a combination of a TIM3 antagonist and a PD-1 antagonist, comprises (i) optionally providing a tissue sample obtained from a subject, wherein the tissue sample comprises CD4+ and/or CD8+ tumor infiltrating lymphocytes (TILs); and (ii) measuring or determining the frequency of PD-1+ CD4+ and/or CD8+ TILs in the tissue sample in view of the frequencies observed in a tissue sample from a control subject (e.g., healthy human subjects).

In some embodiments, a tissue sample obtained from the subject includes, but is not limited to, any clinically relevant tissue sample, such as a tumor biopsy, a core biopsy tissue sample, a fine needle aspirate, or a sample of a bodily fluid, such as blood, plasma, serum, lymph, ascites fluid, cystic fluid, or urine. In some embodiments, the tissue sample is from a metastasis. In some embodiments, tissue samples are taken from a subject at multiple time points, for example, before treatment, during treatment, and/or after treatment. In some embodiments, tissue samples are taken from different locations in the subject, for example, a sample from a primary tumor and a sample from a metastasis in a distant location.

In any of the methods described herein comprising determining or measuring PD-1 expression in a tissue sample, it should be understood that the step comprising obtaining the tissue sample from the patient is an optional step. That is, in certain embodiments, the method includes this step, while in other embodiments, this step is not included. It should also be understood that in certain embodiments, the step of measuring or determining PD-1 expression is performed by a transformative method of assaying for PD-1 expression (e.g., flow cytometry). In other embodiments, no transformative step is involved and the PD-1 expression is determined by, for example, reviewing a report of test results from a laboratory. In certain embodiments, the steps of the methods up to, and including, determining or measuring PD-1 expression result provide an intermediate result that may be provided to a physician or other healthcare provider for use in selecting a suitable candidate for treatment with a combination of a TIM3 antagonist and a PD-1 antagonist. In certain embodiments, the step that provides the intermediate result is performed by a medical practitioner or someone acting under the direction of a medical practitioner. In other embodiments, these steps are performed by an independent laboratory or by an independent person such as a laboratory technician.

In some embodiments, the frequencies of PD-1+ CD4+ and/or PD-1+ CD8+ TILs is assessed by performing an assay to detect the presence of PD-1 RNA. In further embodiments, the presence of PD-1 RNA is detected by RT-PCR, in situ hybridization, or RNase protection. In some embodiments, the presence of PD-1 RNA is detected by an RT-PCR based assay. In other embodiments, scoring the RT-PCR based assay comprises measuring or determining the frequencies of PD1+ CD4+ and/or PD-1+ CD8+ TILs in the tissue sample relative to a predetermined frequency (e.g., observed in a control subject).

In some embodiments, the frequencies of PD-1+ CD4+ and/or PD-1+ CD8+ TILs is assessed by performing an assay to detect the presence of PD-1 protein. In further embodiments, the presence of PD-1 protein is detected by IHC (immunohistochemistry), enzyme-linked immunosorbent assay (ELISA), in vivo imaging, or flow cytometry. In some embodiments, PD-1 expression is assayed by IHC. In other embodiments, cell surface expression of PD-1 is assayed using, e.g., IHC or in vivo imaging.

In some embodiments, the proportion (or frequency) of CD4+ and/or CD8+ cells that express PD-1 in the tissue sample is assessed by flow cytometry. In some embodiments, the tissue sample assayed by flow cytometry comprises tumor infiltrating immune cells (e.g., TILs). In some embodiments the tissue sample assayed by flow cytometry comprises peripheral blood cells. In some embodiments, the flow cytometry is a multiplex assay. In some embodiments, scoring the flow cytometry comprises detecting the expression of markers comprising PD-1, CD4, CD8, CCR7, CD45RO, and any combination thereof. In some embodiments, scoring the flow cytometry comprises assessing the proportion of CD4+ and CD8+ T cells in the tissue sample that express PD-1. In some embodiments, scoring the flow cytometry comprises assessing the proportion of CD8+ and CD4+ T cells in the tissue sample that express PD-1 and are (i) CCR7+ CD45RO− ("naïve T cells"), (ii) CCR7− CD45RO− ("Teff cells"), (iii) CCR7+ CD45RO+ ("CM cells"), or (iv) CCR7− CD45RO+ ("EM cells").

Provided herein are methods for determining (i) whether a subject having cancer is likely to respond to a treatment with an immunotherapeutic agent, such as a TIM3 antagonist, or (ii) whether a subject having cancer is responding to a treatment with an immunotherapeutic agent, such as a TIM3 antagonist, that has been administered to the subject. The methods comprise determining the frequency of TIM3 positive cells among certain populations of cells. In certain embodiments, a method comprises determining the frequency of TIM3 positive cells in a given population of cells in a cancer subject, wherein a higher frequency of TIM3 positive cells of a given population of cells in the cancer subject relative to that in control subjects indicates that the subject is likely to respond to a treatment with an immunotherapeutic agent, such as a TIM3 antagonist. In certain embodiments, a method comprises determining the frequency of TIM3 positive cells in a given population of cells in a cancer subject having received one or more administrations of an immunotherapeutic agent, such as a TIM3 antagonist, wherein a lower frequency of TIM3 positive cells of a given population of cells in the cancer subject after administration of the immunotherapeutic agent relative to that in the cancer subject prior to administration of the immunotherapeutic agent, or prior to administration of a prior dose of immunotherapeutic agent, indicates that the subject is likely to respond to a treatment with an immunotherapeutic agent, such as a TIM3 antagonist. The above methods may comprise measuring (e.g. by flow cytometry) the frequency of TIM3 positive cells in the following populations of cells: Tumor infiltrating cells, such as tumor infiltrating lymphocytes and non-lymphocyte tumor infiltrating cells. In certain embodiments, the methods comprise measuring the frequency of TIM3 positive cells in: CD8+ TIL cells; CD4+ effector memory TIL cells (CD4+ EM cells; CD4+ CCR7−CD45RO+ TIL cells); CD8+ effector memory TIL cells (CD8+ EM cells; CD8+CCR7−CD45RO+ TIL cells); CD4+ effector TIL cells (CD4+ Teff cells; CD4+ CCR7−CD45RO− T cells); CD8+ effector TIL cells (CD8+ Teff cells; CD8+CCR7−CD45RO− T cells); tumor infiltrating myeloid cells, e.g., pDC, mDC and CD14+ myeloid cells; tumor infiltrating NK cells, e.g., CD16−CD56++ NK cells and CD16+CD56+ NK cells. Certain embodiments, comprise measuring the frequency of TIM3 positive cells in more than one of these cell populations, e.g., 2, 3, 4, 5 or more, or all of these cell populations, wherein a higher frequency of TIM3 positive cells in one or more of the cell populations indicates that a subject is likely to respond to a treatment with an immunotherapeutic agent, e.g., a TIM3 antagonist, or wherein a lower frequency of TIM3 positive cells in one or more of the cell populations in a subject having received a dose of immunotherapeutic agent, such as a TIM3 antagonist, relative to its frequency prior to having received the immunotherapeutic agent, indicates that a subject is responding to treatment with the immunotherapeutic agent.

Also provided herein are methods of treating a subject with an immunotherapeutic agent, such as a TIM3 antagonist, comprising administering to a subject having cancer a therapeutically effective amount of the immunotherapeutic agent, such as a TIM3 antagonist, wherein, prior to administering the immunotherapeutic drug, the subject had a higher frequency of TIM3 positive cells in one or more given population of cells, relative to that in control subjects, wherein the one or more given populations of cells are selected from the group consisting of CD8+ TIL cells; CD4+ effector memory TIL cells (CD4+ EM cells; CD4+ CCR7−CD45RO+ TIL cells); CD8+ effector memory TIL cells (CD8+ EM cells; CD8+CCR7−CD45RO+ TIL cells); CD4+ effector TIL cells (CD4+ Teff cells; CD4+CCR7−CD45RO− T cells); CD8+ effector TIL cells (CD8+Teff cells; CD8+ CCR7−CD45RO− T cells); tumor infiltrating myeloid cells, e.g., pDC, mDC and CD14+ myeloid cells; tumor infiltrating NK cells, e.g., CD16−CD56++ NK cells and CD16+CD56+ NK cell.

Also provided herein are methods of treating a subject with an immunotherapeutic agent, such as a TIM3 antagonist, comprising administering to a subject having cancer a therapeutically effective amount of the immunotherapeutic agent, such as a TIM3 antagonist, wherein, after administering a first (or the first few) dose(s) of immunotherapeutic agent, such as a TIM3 antagonist, the subject had a lower frequency of TIM3 positive cells in one or more given population of cells, relative to that prior to administering the first (or first few) dose(s) of immunotherapeutic agent, such as TIM3 antagonist, wherein the one or more given populations of cells are selected from the group consisting of CD8+ TIL cells; CD4+ effector memory TIL cells (CD4+ EM cells; CD4+ CCR7−CD45RO+ TIL cells); CD8+ effector memory TIL cells (CD8+ EM cells; CD8+CCR7−CD45RO+ TIL cells); CD4+ effector TIL cells (CD4+ Teff cells; CD4+CCR7−CD45RO− T cells); CD8+ effector TIL cells (CD8+Teff cells; CD8+CCR7−CD45RO− T cells); tumor infiltrating myeloid cells, e.g., pDC, mDC and CD14+ myeloid cells; tumor infiltrating NK cells, e.g., CD16−CD56++ NK cells and CD16+CD56+ NK cell.

Further provided herein are methods of treating a subject with an immunotherapeutic agent, such as a TIM3 antagonist, comprising first determining whether the subject is likely to respond to a treatment with an immunotherapeutic agent, such as a TIM3 antagonist, e.g., as described herein (e.g., previous paragraphs), and if so, administering a therapeutically effective amount of the immunotherapeutic agent, such as a TIM3 antagonist.

TIM3 Antagonists

In one aspect, the present disclosure features methods of using TIM3 antagonists for the treatment of cancers. As used herein, TIM3 antagonists include, but are not limited to, anti-TIM3 antibodies, and antigen binding portions thereof, and soluble TIM3 polypeptides (e.g., TIM3-Fc fusion protein that is capable of binding to a TIM3 ligand). Other TIM3 antagonists include agents that bind to ligands of TIM3 and inhibit their interaction with TIM3.

Anti-TIM3 Antibodies

Certain aspects of the present disclosure comprise administering to a subject in need thereof a therapeutically effective amount of an anti-TIM3 antibody, or an antigen-binding portion thereof. The anti-TIM3 antibodies (or VH/VL domains derived therefrom) suitable for use in the present disclosure can be generated using methods well known in the art. Alternatively, art recognized anti-TIM3 antibodies can be used.

In some embodiments, the anti-TIM3 antibodies, or antigen-binding portions thereof, exhibit one or more of the following functional properties:
(a) binding to soluble and/or membrane bound human TIM3;
(b) binding to soluble and/or membrane bound cyno TIM3;
(c) inducing or stimulating an immune response;
(d) inducing or stimulating T cell activation, e.g., Th1 cell activation (as evidenced, e.g., by enhanced cytokine secretion and/or proliferation);
(e) inducing or stimulating T cell proliferation (e.g., CD4+, CD8+ T cells, Th1 cells, or TILs), e.g., in a coculture assay;
(f) inducing or stimulating IFN-γ production by T cells, e.g., Th1 cells or tumor infiltrating lymphocytes (TILs), such as TILs from human renal, lung, pancreatic, or breast cancer tumors;
(g) blocking or inhibiting the binding of human TIM3 to PtdSer;
(h) not internalizing or downregulating cell surface TIM3 when binding to TIM3 on cells;
(i) binding to human TIM3 extracellular domain (i) CPVFECG (SEQ ID NO: 200); (ii) RIQIPGIMND (SEQ ID NO: 202); (iii) CPVFECG and RIQIPGIMND (SEQ ID NOs: 200 and 202, respectively); or (iv) WTSRYWLNGDFR (SEQ ID NO: 201);
(j) competing with, or cross-blocking, the binding to human TIM3 of an antibody binding to TIM3 described herein (e.g., 13A3, 3G4, 17C3, 17C8, 9F6, or any of TIM3.2 to TIM3.18);
(k) binding to human TIM3, but not to human TIM3 having an amino acid substitution of one or more of the following amino acid residues: L48, C58, P59, V60, F61, E62, C63, G64, W78, S80, R81, W83, L84, G86, D87, R89, D104, R111, Q113, G116, M118, and D120, as numbered in SEQ ID NO: 194; and
(l) binding to human TIM3 regions $^{49}$VPVCWGKGACPVFE$^{62}$ (SEQ ID NO: 204) and $^{111}$RIQIPGIMNDEKFNLKL127 (SEQ ID NO: 205) as determined by HDX-MS;
(m) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography; and/or
(n) competing with or cross-blocking with the binding to human TIM3 of 13A3 or TIM3.18.IgG1.3.

In some embodiments, the anti-TIM3 antibodies bind to human TIM3 with high affinity, for example, with a $K_D$ of $10^{-7}$ M or less, $10^{-8}$ M or less, $10^{-9}$ M or less, $10^{-10}$ M or less, $10^{-11}$ M or less, $10^{-12}$ M or less, $10^{-12}$ M to $10^{-7}$ M, $10^{-11}$ M to $10^{-7}$ M, $10^{-10}$ M to $10^{-7}$ M, or $10^{-9}$ M to $10^{-7}$ M. In certain embodiments, an anti-TIM3 antibody binds to soluble human TIM3, e.g., as determined by BIACORE™, with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-7}$ M, $10^{-10}$ M to $10^{-7}$ M, $10^{-9}$ M to $10^{-7}$ M, or $10^{-8}$ M to $10^{-7}$ M. In some embodiments, an anti-TIM3 antibody binds to bound (e.g., cell membrane bound) human TIM3, such as on activated human CD4+ and CD8+ TILs, e.g., as determined by flow cytometry and Scatchard plot, with a $K_D$ of $10^{-7}$ M or less, $10^{-8}$ M or less, $10^{-9}$ M (1 nM) or less, $5\times10^{-10}$ M or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, or $10^{-10}$ M to $10^{-9}$ M. In other embodiments, an anti-TIM3 antibody binds to bound (e.g., cell membrane bound) human TIM3, such as on activated human CD4+ and CD8+ TILs, e.g., as determined by flow cytometry, with an $EC_{50}$ of 10 ug/mL or less, 5 ug/mL or less, 1 ug/mL or less, 0.9 ug/mL or less, 0.8 ug/mL or less, 0.7 ug/mL or less, 0.6 ug/mL or less, 0.5 ug/mL or less, 0.4 ug/mL or less, 0.3 ug/mL or less, 0.2 ug/mL or less, 0.1 ug/mL or less, 0.05 ug/mL or less, or 0.01 ug/mL or less.

In some embodiments, the anti-TIM3 antibodies suitable for the current disclosure bind to cyno TIM3, for example, with a $K_D$ of $10^{-7}$ M or less, $10^{-8}$ M or less, $10^{-9}$ M or less, $10^{-10}$ M or less, $10^{-11}$ M or less, $10^{-12}$ M or less, $10^{-12}$ M to $10^{-7}$ M, $10^{-11}$ M to $10^{-7}$ M, $10^{-10}$ M to $10^{-7}$ M, or $10^{-9}$ M to $10^{-7}$ M. In certain embodiments, an anti-TIM3 antibody binds to soluble cyno TIM3, e.g., as determined by BIACORE™, with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-7}$ M, $10^{-10}$ M to $10^{-7}$ M, $10^{-9}$ M to $10^{-7}$ M, or $10^{-8}$ M to $10^{-7}$ M. In other embodiments, the anti-TIM3 antibodies can bind to membrane bound cynomolgus TIM3, e.g., with an $EC_{50}$ of 100 nM or less, 10 nM or less, 100 nM to 0.01 nM, 100 nM to 0.1 nM, 100 nM to 1 nM, or 10 nM to 1 nM, e.g., as measured by flow cytometry. In certain embodiments, an anti-TIM3 antibody binds to bound (e.g., cell membrane bound) cyno TIM3, such as on activated human CD4+ and CD8+ TILs, e.g., as determined by flow cytometry and Scatchard plot, with a $K_D$ of $10^{-7}$ M or less, $10^{-8}$ M or less, $10^{-9}$ M (1 nM) or less, $5\times10^{-10}$ M or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, or $10^{-10}$ M to $10^{-9}$ M.

In some embodiments, the anti-TIM3 antibodies stimulate or enhance an immune response, e.g., by activating T cells, e.g., in the tumor. For example, the anti-TIM3 antibodies can activate or costimulate cells, as evidenced, e.g., by enhanced cytokine (e.g., IFN-γ) secretion and/or enhanced proliferation, which may result from the inhibition of TIM3 mediated T cell inhibitory activity. In certain embodiments, T cell activation or co-stimulation by a TIM3 antibody occurs in the presence of CD3 stimulation. In certain embodiments, an anti-TIM3 antibody increases IFN-γ secretion by a factor of 50%, 100% (i.e., 2 fold), 3 fold, 4 fold, 5 fold or more, optionally with a maximum of up to 10 fold, 30 fold, 100 fold, as measured, e.g., on primary human T cells and/or T cells expressing human TIM3, such as tumor infiltrating lymphocytes (TILs).

In some embodiments, the anti-TIM3 antibodies inhibit binding of phosphatidylserine to human TIM3 on cells, e.g., CHO cells or activated T cells expressing human TIM3, e.g., with an $EC_{50}$ of 10 μg/ml or less, 1 μg/ml or less, 0.01 μg/ml to 10 μg/ml, 0.1 μg/ml to 10 μg/ml, or 0.1 μg/ml to 1 μg/ml.

In some embodiments, anti-TIM3 antibodies suitable for the present disclosure bind to an epitope, e.g., a conformational epitope, in the extracellular portion of human TIM3, e.g., in the Ig like domain of the extracellular region, i.e., amino acids 22 to 202 of SEQ ID NO: 194. In certain embodiments, an anti-TIM3 antibody binds to an epitope located within amino acids 22 to 120 of human TIM3 extracellular domain (SEQ ID NO: 194) or 1-99 of mature human TIM3 (SEQ ID NO: 198). In some embodiments, an anti-TIM3 antibody binds to, or to an epitope within, a region consisting of amino acids 58-64 of human TIM3 having SEQ ID NO: 194, which corresponds to amino acid residues 37-43 of mature human TIM3 (CPVFECG, SEQ ID NO: 200). In other embodiments, an anti-TIM3 antibody binds to, or to an epitope within, a region consisting of amino acids 111-120 of human TIM3 having SEQ ID NO: 194, which corresponds to amino acid residues 90-99 of mature human TIM3 (RIQIPGIMND, SEQ ID NO: 202). In certain embodiments, an anti-TIM3 antibody binds to, or to an epitope within, a region consisting of a region consisting of amino acids 58-64 of human TIM3 having SEQ ID NO: 194 (CPVFECG, SEQ ID NO: 200) and to, or to an epitope within, a region consisting of amino acids 111-120 of human TIM3 having SEQ ID NO: 194 (RIQIPGIMND, SEQ ID NO: 202). In some embodiments, an anti-TIM3 antibody binds to, or to an epitope within, a region consisting of amino acids 78-89 of human TIM3 having SEQ ID NO: 194, which corresponds to amino acid residues 57-83 of mature human TIM3 (WTSRYWLNGDFR, SEQ ID NO: 201).

In some embodiments, an anti-TIM3 antibody binds to substantially the same epitope as that of 13A3, i.e., an epitope (or region of human TIM3) comprising one or more of amino acid residues C58, P59, F61, E62, C63, R111, and D120 of SEQ ID NO: 194. In some embodiments, an anti-TIM3 antibody binds to an epitope (or region of human TIM3) comprising one or more of amino acid residues C58, P59, F61, E62, C63, D104, R111, Q113 and D120 of SEQ ID NO: 194. In certain embodiments, an anti-TIM3 antibody does not bind significantly, or only with significantly reduced binding affinity, to a human TIM3 protein in which one or more of amino acid residues C58, P59, F61, E62, C63, R111, and D120 of SEQ ID NO: 194 is changed to another amino acid, e.g., in a non-conservative amino acid substitution. In other embodiments, an anti-TIM3 antibody does not bind significantly, or only with significantly reduced binding affinity, to a human TIM3 protein in which one or more of amino acid residues C58, P59, F61, E62, C63, D104, R111, Q113 and D120 of SEQ ID NO: 194 is changed to another amino acid, e.g., in a non-conservative amino acid substitution.

In some embodiments, an anti-TIM3 antibody binds to substantially the same epitope as that of 3G4, i.e., an epitope (or region of human TIM3) comprising one or more of amino acids residues C58, P59, V60, F61, E62, C63, G116, and M118 of SEQ ID NO: 194. In some embodiments, an anti-TIM3 antibody binds to an epitope (or region of human TIM3) comprising one or more of amino acid residues C58, P59, V60, F61, E62, C63, D104, G116, and M118 of SEQ ID NO: 194. In certain embodiments, an anti-TIM3 antibody does not bind significantly, or only with significantly reduced binding affinity, to a human TIM3 protein in which one or more of amino acid residues C58, P59, V60, F61, E62, C63, G116, and M118 of SEQ ID NO: 194 is changed to another amino acid, e.g., in a non-conservative amino acid substitution. In certain embodiments, an anti-TIM3 antibody does not bind significantly, or only with significantly reduced binding affinity, to a human TIM3 protein in which one or more of amino acid residues C58, P59, V60, F61, E62, C63, D104, G116, and M118 of SEQ ID NO: 194 is changed to another amino acid, e.g., in a non-conservative amino acid substitution.

In some embodiments, an anti-TIM3 antibody binds to substantially the same epitope as that of 17C3, i.e., an epitope (or region of human TIM3) comprising one or more of amino acids residues C58, P59, V60, F61, E62, C63, G64, and G116 of SEQ ID NO: 194. In some embodiments, an anti-TIM3 antibody binds to an epitope (or region of human TIM3) comprising one or more of amino acid residues C58, P59, V60, F61, E62, C63, G64, D104, and G116 of SEQ ID NO: 194. In certain embodiments, an anti-TIM3 antibody does not bind significantly, or only with significantly reduced binding affinity, to a human TIM3 protein in which one or more of amino acid residues C58, P59, V60, F61, E62, C63, G64, and G116 of SEQ ID NO: 194 is changed to another amino acid, e.g., in a non-conservative amino acid substitution. In certain embodiments, an anti-TIM3 antibody does not bind significantly, or only with significantly reduced binding affinity, to a human TIM3 protein in which one or more of amino acid residues C58, P59, V60, F61, E62, C63, G64, D104, and G116 of SEQ ID NO: 194 is changed to another amino acid, e.g., in a non-conservative amino acid substitution.

In some embodiments, an anti-TIM3 antibody binds to substantially the same epitope as that of 8B9, i.e., an epitope (or region of human TIM3) comprising one or more of amino acids residues L48, W78, S80, R81, W83, G86, D87, and R89 of SEQ ID NO: 194. In some embodiments, an anti-TIM3 antibody binds to an epitope (or region of human TIM3) comprising one or more amino acid residues L48, W78, S80, R81, W83, L84, G86, D87, and R89 of SEQ ID NO: 194. In other embodiments, an anti-TIM3 antibody binds to an epitope (or region of human TIM3) comprising one or more of amino acids residues L48, W78, S80, R81, W83, G86, D87, R89, and D104 of SEQ ID NO: 194. In certain embodiments, an anti-TIM3 antibody does not bind significantly, or only with significantly reduced binding affinity, to a human TIM3 protein in which one or more of amino acid residues L48, W78, S80, R81, W83, G86, D87, and R89 of SEQ ID NO: 194 is changed to another amino acid, e.g., in a non-conservative amino acid substitution. In other embodiments, an anti-TIM3 antibody does not bind significantly, or only with significantly reduced binding affinity, to a human TIM3 protein in which one or more of amino acid residues L48, W78, S80, R81, W83, L84, G86, D87, and R89 of SEQ ID NO: 194 is changed to another amino acid, e.g., in a non-conservative amino acid substitution. In some embodiments an anti-TIM3 antibody does not bind significantly, or only with significantly reduced binding affinity, to a human TIM3 protein in which one or more of amino acid residues L48, W78, S80, R81, W83, G86, D87, R89, and D104 of SEQ ID NO: 194 is changed to another amino acid, e.g., in a non-conservative amino acid substitution.

In other embodiments, anti-TIM3 antibodies suitable to be used with the current disclosure compete for binding to human TIM3 with (or inhibit binding of) anti-TIM3 antibodies comprising CDRs or variable regions described herein, e.g., those of antibodies 13A3, 3G4, 17C3, 17C8, 9F6, 8B9, 8C4 and any of TIM3.2 to TIM3.18. In certain embodiments, anti-TIM3 antibodies inhibit binding of antibodies 13A3, 3G4, 17C3, 17C8, 9F6, 8B9, 8C4 or any of TIM3.2 to TIM3.18 to human TIM3 by at least 50%, 60%, 70%, 80%, 90% or by 100%. In some embodiments, 13A3, 3G4, 17C3, 17C8, 9F6, 8B9, 8C4 or any of TIM3.2 to TIM3.18 inhibit binding of anti-TIM3 antibodies to human TIM3 by at least 50%, 60%, 70%, 80%, 90% or by 100%. In other embodiments, anti-TIM3 antibodies inhibit binding of 13A3, 3G4, 17C3, 17C8, 9F6, 8B9, 8C4 or any of TIM3.2 to TIM3.18 to human TIM3 by at least 50%, 60%, 70%, 80%, 90% or by 100% and 13A3, 3G4, 17C3, 17C8, 9F6, 8B9, 8C4 or any of TIM3.2 to TIM3.18 inhibit binding of the anti-TIM3 antibodies to human TIM3 by at least 50%, 60%, 70%, 80%, 90% or by 100% (e.g., compete in both directions).

In certain embodiments, the anti-TIM3 antibodies disclosed herein have 1, 2, 3, 4, 5, 6, 7, 8, 9, 10, 11, 12, 13, 14, 15, or all of the following features:

(1) binding to soluble human TIM3, e.g., with a $K_D$ of 10 nM or less (e.g., 0.01 nM to 10 nM), e.g., as measured by Biacore;

(2) binding to soluble cynomolgus TIM3, e.g., with a $K_D$ of 100 nM or less (e.g., 0.01 nM to 100 nM), e.g., as measured by Biacore;

(3) binding to membrane bound human TIM3, e.g., with an $EC_{50}$ of 1 µg/mL or less (e.g., 0.01 µg/mL to 1 µg/mL), e.g., as measured by flow cytometry;

(4) binding to membrane bound human TIM3, e.g., with a $K_D$ of 1 nM or less (e.g., 0.01 nM to 10 nM), e.g., as measured by Scatchard analysis;

(5) binding to membrane bound cynomolgus TIM3, e.g., with an $EC_{50}$ of 20 µg/mL or less (e.g., 0.01 µg/mL to 20 µg/mL), e.g., as measured by flow cytometry;

(6) binding to membrane bound cynomolgus TIM3, e.g., with a $K_D$ of 1 nM or less (e.g., 0.01 nM to 10 nM), e.g., as measured by Scatchard analysis;

(7) inducing or enhancing T cell activation (e.g., by blocking or reducing the inhibitory effects of TIM3), as evidenced by (i) increased IFN-γ production in TIM3-expressing T cells (e.g., Th1 cells or TILs) and/or (ii) enhanced proliferation of TIM-3 expressing T cells (e.g., Th1 cells or TILs);

(8) stimulating T cell proliferation in a mixed lymphocyte reaction (MLR) assay;

(9) inhibiting the binding of phosphatidylserine to TIM3;

(10) not internalizing or downregulating cell surface TIM3 when binding to TIM3 on cells;

(11) binding to one of the following regions of human TIM3 extracellular domain (SEQ ID NO: 198): (a) CPVFECG (SEQ ID NO: 200); (b) RIQIPGIMND (SEQ ID NO: 202); (c) CPVFECG and RIQIPGIMND (SEQ ID NOs: 200 and 202, respectively); and (d) WTSRYWLNGDFR (SEQ ID NO: 201);

(12) having reduced binding to human TIM3 in which one or more of amino acids L48, C58, P59, V60, F61, E62, C63, G64, W78, S80, R81, W83, L84, G86, D87, R89, D104, R111, Q113, G116, M118, and D120 (as numbered in SEQ ID NO: 194) is substituted with another amino acid relative to binding to wildtype human TIM3;

(13) competing in either direction or both directions for binding to human TIM3 with an antibody comprising VH and VL domains of any one of 13A3, 3G4, 17C3, 17C8, 9F6, 8B9, 8C4, or TIM3.7, TIM3.8, TIM3.10, TIM3.11, TIM3.12, TIM3.13, TIM3.14, TIM3.15, TIM3.16, TIM3.18;

(14) binding to human TIM3 regions $^{49}$VPVCWGKGACPVFE$^{62}$ (SEQ ID NO: 204) and $^{111}$RIQIPGIMNDEKFNLKL$^{127}$ (SEQ ID NO: 205) as determined by HDX-MS;

(15) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (numbering per SEQ ID NO: 194); and/or

(16) (a) having reduced binding to human TIM3 in which 1, 2, 3, 4, 5, 6, 7, 8 or 9 of amino acids C58, P59, F61, E62, C63, R111, D120, and optionally D104 and Q113 (numbering per SEQ ID NO: 194) are substituted with another amino acid relative to binding to wildtype human TIM3; (b) binding to $^{49}$VPVCWGKGACPVFE$^{62}$ (SEQ ID NO: 204), $^{111}$RIQIPGIMNDEKFNLKL$^{127}$ (SEQ ID NO: 205) and $^{119}$NDEKFNLKL$^{127}$ (SEQ ID NO: 210), as determined by HDX-MS; and/or (c) competing with or cross-blocking with the binding to human TIM3 of 13A3 or TIM3.18.IgG1.3.

Accordingly, an antibody that exhibits one or more of these functional properties (e.g., biochemical, immunochemical, cellular, physiological or other biological activities, or the like) as determined according to methodologies known to the art and described herein, will be understood to exhibit a statistically significant difference in the particular activity relative to that seen in the absence of the antibody (e.g., or when a control antibody of irrelevant specificity is present). In some embodiments, anti-TIM3 antibody-induced increases in a measured parameter (e.g., T cell proliferation, cytokine production) in a given assay effects a statistically significant increase by at least 10% of the measured parameter, e.g., by at least 20%, 30%, 40%, 50%, 60%, 70%, 80%, 90%, 95%, 100% (i.e., 2 fold), 3 fold, 5 fold or 10 fold, and in certain embodiments, an antibody described herein can increase the measured parameter, e.g., by greater than 92%, 94%, 95%, 97%, 98%, 99%, 100% (i.e., 2 fold), 3 fold, 5 fold or 10 fold, relative to the same assay conducted in the absence of the antibody. Conversely, anti-TIM3 antibody-induced decreases in a measured parameter (e.g., tumor volume, TIM3-L binding to human TIM3) in a given assay effects a statistically significant decrease by at least 10% of the measured parameter, e.g., by at least 20%, 30%, 40%, 50%, 60%, 70%, 80% or 90%, and in certain embodiments, an antibody described herein can decrease the measured parameter, e.g., by greater than 92%, 94%, 95%, 97%, 98% or 99%, relative to the same assay conducted in the absence of the antibody.

Standard assays to evaluate the binding ability of the antibodies toward TIM3 of various species are known in the art, including for example, ELISAs, Western blots, and RIAs. The binding kinetics (e.g., binding affinity) of the antibodies can also be assessed by standard assays known in the art, such as by Biacore analysis.

In some embodiments, anti-TIM3 antibodies suitable for the present disclosure are not native antibodies or are not naturally-occurring antibodies. For example, in some embodiments, the anti-TIM3 antibodies have post-translational modifications that are different from those of antibodies that are naturally occurring, such as by having more, less or a different type of post-translational modification.

In some embodiments, the anti-TIM3 antibodies do not have agonist activity, as determined, e.g., in cross-linking of anti-TIM3 antibodies in CHO-OKT3-CD32:T cell co-culture experiments, in which such antibodies do not enhance activity beyond anti-TIM3 alone. In certain embodiments, anti-TIM3 antibodies block the interaction of TIM3 with its ligand without promoting agonist activity.

In some embodiments, the anti-TIM3 antibodies enhance IL-12 production from monocytes or dendritic cells treated with LPS.

In some embodiments, the anti-TIM3 antibodies revive tumor infiltrating CD4+ and CD8+ T cells that co-express PD-1 and TIM3 by combined treatment, hence avoiding depletion of CD4+ and CD8+ T cells.

Exemplary Anti-TIM3 Antibodies

Particular anti-TIM3 antibodies suitable for the present disclosure are antibodies, e.g., monoclonal, recombinant, and/or human antibodies, having the CDR and/or variable region sequences of antibodies 13A3, 3G4, 17C3, 17C8, 9F6, 8B9, 8C4 or any one of TIM3.2 to TIM3.18, as well as antibodies having at least 80% identity (e.g., at least 85%, at least 90%, at least 95%, or at least 99% identity) to their variable region or CDR sequences. The VH amino acid sequences of 13A3, 8B9, 8C4, 17C3, 9F6, 3G4, and 17C8 are set forth in SEQ ID NOs: 1-7, respectively. The VH amino acid sequences of 13A3, 8B9 and 9F6 variants set forth in SEQ ID NOs: 8-18. The VL amino acid sequences of 13A3, 17C3, and 3G4 are set forth in SEQ ID NO: 19. The VL amino acid sequences of 8B9, 8C4, and 17C8 are set forth in SEQ ID NO: 20. The VL amino acid sequence of 9F6 or its variants are set forth in SEQ ID NOs: 20, 21,or 22. The VL amino acid sequences of the 13A3 and 8B9 variants are set forth in SEQ ID NO: 19 and SEQ ID NO: 20, respectively.

Accordingly, in some embodiments, the anti-TIM3 antibodies comprise heavy and light chain variable regions, wherein the heavy chain variable region comprises an amino acid sequence selected from the group consisting of SEQ ID NOs: 1-18. In some embodiments, the light chain variable region comprises an amino acid sequence selected from the group consisting of SEQ ID NOs: 19-22.

In some embodiments, the anti-TIM3 antibodies comprise:
(a) heavy and light chain variable region sequences comprising SEQ ID NOs: 1 and 19, respectively;
(b) heavy and light chain variable region sequences comprising SEQ ID NOs: 2 and 20, respectively;
(c) heavy and light chain variable region sequences comprising SEQ ID NOs: 3 and 20, respectively;
(d) heavy and light chain variable region sequences comprising SEQ ID NOs: 4 and 19, respectively;
(e) heavy and light chain variable region sequences comprising SEQ ID NOs: 5 and 20, respectively;
(f) heavy and light chain variable region sequences comprising SEQ ID NOs: 5 and 21, respectively;
(g) heavy and light chain variable region sequences comprising SEQ ID NOs: 5 and 22, respectively;
(h) heavy and light chain variable region sequences comprising SEQ ID NOs: 6 and 19, respectively;
(i) heavy and light chain variable region sequences comprising SEQ ID NOs: 7 and 20, respectively;
(j) heavy and light chain variable region sequences comprising SEQ ID NOs: 17 and 22, respectively;
(k) heavy and light chain variable region sequences comprising SEQ ID NOs: 16 and 20, respectively;
(l) heavy and light chain variable region sequences comprising SEQ ID NOs: 8 and 19, respectively;
(m) heavy and light chain variable region sequences comprising SEQ ID NOs: 9 and 19, respectively;
(n) heavy and light chain variable region sequences comprising SEQ ID NOs: 10 and 19, respectively;
(o) heavy and light chain variable region sequences comprising SEQ ID NOs: 11 and 19, respectively;
(p) heavy and light chain variable region sequences comprising SEQ ID NOs: 12 and 19, respectively;
(q) heavy and light chain variable region sequences comprising SEQ ID NOs: 13 and 19, respectively;
(r) heavy and light chain variable region sequences comprising SEQ ID NOs: 14 and 19, respectively;
(s) heavy and light chain variable region sequences comprising SEQ ID NOs: 15 and 19, respectively; or
(t) heavy and light chain variable region sequences comprising SEQ ID NOs: 18 and 19, respectively.

In some embodiments, the anti-TIM3 antibodies comprises the heavy and light chain CDR1s, CDR2s and CDR3s of 13A3, 8B9, 8C4, 17C3, 9F6, 3G4, and 17C8 or any one of TIM3.2 to TIM3.18, or combinations thereof. The amino acid sequences of the VH CDR1s of 13A3, 8B9, 8C4, and 17C3 are set forth in SEQ ID NOs: 23-26, respectively. The amino acid sequences of the VH CDR1s of 9F6, 3G4, and 17C8 are set forth in SEQ ID NO: 27. The amino acid sequence of the VH CDR1 of the mutated 13A3 antibodies (i.e., TIM3.10-TIM3.18) is the same as that of the nonmutated 13A3 antibody, i.e., SEQ ID NO: 23. The amino acid sequence of the VH CDR1 of the mutated 8B9 antibody (i.e., TIM3.8) is the same as that of the nonmutated 8B9 antibody, i.e., SEQ ID NO: 24. The amino acid sequence of the VH CDR1 of the mutated 9F6 antibody (i.e., TIM3.7) is the same as that of the nonmutated 9F6 antibody, i.e., SEQ ID NO: 27. The amino acid sequences of the VH CDR2s of 13A3, 8B9, 8C4, 17C3, 9F6, 3G4, and 17C8 are set forth in SEQ ID NOs: 28-34, respectively. The amino acid sequence of the VH CDR2s of the mutated 13A3 antibodies TIM3.10, TIM3.17, and TIM3.18 is set forth in SEQ ID NO: 35. The amino acid sequence of the VH CDR2s of the mutated 13A3 antibodies TIM3.11 and TIM3.12 are set forth in SEQ ID NOs: 36 and 37, respectively. The amino acid sequence of the VH CDR2 of the mutated 13A3 antibodies TIM3.13 and TIM3.16 is that of the nonmutated 13A3 antibody, i.e., SEQ ID NO: 28. The amino acid sequence of the VH CDR2 of the mutated 8B9 antibody (i.e., TIM3.8) is set forth in SEQ ID NO: 38. The amino acid sequence of the VH CDR2 of the mutated 9F6 antibody (i.e., TIM3.7) is the same as that of the nonmutated 9F6 antibody, i.e., SEQ ID NO: 32. The amino acid sequences of the VH CDR3s of 13A3, 8B9, 8C4, 17C3, 9F6, 3G4, and 17C8 are set forth in SEQ ID NOs: 39-45, respectively.

The amino acid sequence of the VH CDR3s of the mutated 13A3 antibodies (i.e., TIM3.10 to TIM3.12 is that of the nonmutated 13A3 antibody, i.e., SEQ ID NO: 39. The amino acid sequence of the VH CDR3s of the mutated 13A3 antibodies TIM3.13 and TIM3.18 is set forth in SEQ ID NO: 46. The amino acid sequence of the VH CDR3s of the mutated 13A3 antibodies TIM3.15 and TIM3.17 is set forth in SEQ ID NO: 48. The amino acid sequences of the VH CDR3s of the mutated 13A3 antibodies TIM3.14 and TIM3.16 are set forth in SEQ ID NOs: 47 and 49, respectively. The amino acid sequence of the VH CDR3 of the mutated 8B9 antibody (i.e., TIM3.8) is that of the nonmutated 8B9 antibody, i.e., SEQ ID NO: 40. The amino acid sequence of the VH CDR3 of the mutated 9F6 antibody (i.e., TIM3.7) is the same as that of the nonmutated 9F6 antibody, i.e., SEQ ID NO: 43.

The amino acid sequences of the VL CDR1s of 13A3, 8B9, 8C4, 17C3, 3G4, and 17C8 are set forth in SEQ ID NO: 50. The amino acid sequences of the VL CDR1 of 9F6 is set forth in SEQ ID NOs: 50 and 51. The amino acid sequences of the VL CDR2s of 13A3, 8B9, 8C4, 17C3, 3G4, and 17C8 are set forth in SEQ ID NO: 52. The amino acid sequences of the VL CDR2 of 9F6 is set forth in SEQ ID NOs: 52 and 53. The amino acid sequences of the VL CDR3s of 13A3, 17C3, and 3G4 are set forth in SEQ ID NO: 54. The amino acid sequences of the VL CDR3s of 8B9, 8C4, and 17C8 are set forth in SEQ ID NO: 55. The amino acid sequences of the VL CDR3 of 9F6 are set forth in SEQ ID NOs: 55-57. The amino acid sequences of the VL CDRs of the mutated antibodies 13A3, 8B9 and 9F6 are those of the corresponding nonmutated antibodies.

The CDR regions are delineated using the Kabat system (Kabat, E. A., et al. (1991) Sequences of Proteins of Immunological Interest, Fifth Edition, U.S. Department of Health and Human Services, NIH Publication No. 91-3242). Kabat system is the most common numbering system for a scheme called the EU index or EU numbering system, which is based on the sequential numbering of the first human IgG1 sequenced (the EU antibody; Edelman et al. 1969). Based on the Kabat numbering scheme disclosed herein, the antibody numbering can be converted into other systems known in the art, e.g., Chothia, IMGT, Martin (enhanced Chothia), or AHo numbering scheme.

In some embodiments, the anti-TIM3 antibodies, or antigen binding portion thereof, comprise:
(a) a heavy chain variable region CDR1 comprising an amino acid sequence selected from the group consisting of SEQ ID NOs: 23-27;
(b) a heavy chain variable region CDR2 comprising an amino acid sequence selected from the group consisting of SEQ ID NOs: 28-38;
(c) a heavy chain variable region CDR3 comprising an amino acid sequence selected from the group consisting of SEQ ID NOs: 39-49;
(d) a light chain variable region CDR1 comprising an amino acid sequence selected from the group consisting of SEQ ID NOs: 50 and 51;
(e) a light chain variable region CDR2 comprising an amino acid sequence selected from the group consisting of SEQ ID NOs: 52 and 53; or
(f) a light chain variable region CDR3 comprising an amino acid sequence selected from the group consisting of SEQ ID NOs: 54-57;
wherein the antibody specifically binds to human TIM3.

In some embodiments, the anti-TIM3 antibodies comprises heavy and light chain variable regions, wherein the heavy chain variable region CDR1, CDR2, and CDR3 regions comprise:
(a) SEQ ID NOs: 23, 28, and 39;
(b) SEQ ID NOs: 24, 29, and 40;
(c) SEQ ID NOs: 25, 30, and 41;
(d) SEQ ID NOs: 26, 31, and 42;
(e) SEQ ID NOs: 27, 32, and 43;
(f) SEQ ID NOs: 27, 33, and 44;
(g) SEQ ID NOs: 27, 34, and 45;
(h) SEQ ID NOs: 23, 35, and 39;
(i) SEQ ID NOs: 23, 36, and 39;
(j) SEQ ID NOs: 23, 37, and 39;
(k) SEQ ID NOs: 23, 28, and 46;
(l) SEQ ID NOs: 23, 28, and 47;
(m) SEQ ID NOs: 23, 28, and 48;
(n) SEQ ID NOs: 23, 28, and 49;
(o) SEQ ID NOs: 23, 35, and 46; or
(p) SEQ ID NOs: 23, 35, and 48;
wherein the antibody specifically binds to human TIM3.

In some embodiments, the anti-human TIM3 antibody comprises heavy and light chain variable regions, wherein the light chain variable region CDR1, CDR2, and CDR3 regions comprise:
(a) SEQ ID NOs: 50, 52, and 54;
(b) SEQ ID NOs: 50, 52, and 55;
(c) SEQ ID NOs: 51, 53, and 56; or
(d) SEQ ID NOs: 50, 52, and 57;
wherein the antibody specifically binds to human TIM3.

In some embodiments, the anti-TIM3 antibody comprises heavy and light chain variable regions, wherein:
(a1) the heavy chain variable region CDR1, CDR2, and CDR3 comprises SEQ ID NOs: 23, 28, and 39, respectively, and the light chain variable region CDR1, CDR2, and CDR3 comprises SEQ ID NOs: 50, 52, and 54, respectively;

(a2) the heavy chain variable region CDR1, CDR2, and CDR3 comprises SEQ ID NOs: 23, 35, and 39, respectively, and the light chain variable region CDR1, CDR2, and CDR3 comprises SEQ ID NOs: 50, 52, and 54, respectively;
(a3) the heavy chain variable region CDR1, CDR2, and CDR3 comprises SEQ ID NOs: 23, 36, and 39, respectively, and the light chain variable region CDR1, CDR2, and CDR3 comprises SEQ ID NOs: 50, 52, and 54, respectively;
(a4) the heavy chain variable region CDR1, CDR2, and CDR3 comprises SEQ ID NOs: 23, 37, and 39, respectively, and the light chain variable region CDR1, CDR2, and CDR3 comprises SEQ ID NOs: 50, 52, and 54, respectively;
(a5) the heavy chain variable region CDR1, CDR2, and CDR3 comprises SEQ ID NOs: 23, 28, and 46, respectively, and the light chain variable region CDR1, CDR2, and CDR3 comprises SEQ ID NOs: 50, 52, and 54, respectively;
(a6) the heavy chain variable region CDR1, CDR2, and CDR3 comprises SEQ ID NOs: 23, 28, and 47, respectively, and the light chain variable region CDR1, CDR2, and CDR3 comprises SEQ ID NOs: 50, 52, and 54, respectively;
(a7) the heavy chain variable region CDR1, CDR2, and CDR3 comprises SEQ ID NOs: 23, 28, and 48, respectively, and the light chain variable region CDR1, CDR2, and CDR3 comprises SEQ ID NOs: 50, 52, and 54, respectively;
(a8) the heavy chain variable region CDR1, CDR2, and CDR3 comprises SEQ ID NOs: 23, 28, and 49, respectively, and the light chain variable region CDR1, CDR2, and CDR3 comprises SEQ ID NOs: 50, 52, and 54, respectively;
(a9) the heavy chain variable region CDR1, CDR2, and CDR3 comprises SEQ ID NOs: 23, 35, and 46, respectively, and the light chain variable region CDR1, CDR2, and CDR3 comprises SEQ ID NOs: 50, 52, and 54, respectively;
(a10) the heavy chain variable region CDR1, CDR2, and CDR3 comprises SEQ ID NOs: 23, 35, and 48, respectively, and the light chain variable region CDR1, CDR2, and CDR3 comprises SEQ ID NOs: 50, 52, and 54, respectively;
(b1) the heavy chain variable region CDR1, CDR2, and CDR3 comprises SEQ ID NOs: 24, 29, and 40, respectively, and the light chain variable region CDR1, CDR2, and CDR3 comprises SEQ ID NOs: 50, 52, and 55, respectively;
(b2) the heavy chain variable region CDR1, CDR2, and CDR3 comprises SEQ ID NOs: 24, 38, and 40, respectively, and the light chain variable region CDR1, CDR2, and CDR3 comprises SEQ ID NOs: 50, 52, and 55, respectively;
(c) the heavy chain variable region CDR1, CDR2, and CDR3 comprises SEQ ID NOs: 25, 30, and 41, respectively, and the light chain variable region CDR1, CDR2, and CDR3 comprises SEQ ID NOs: 50, 52, and 55, respectively;
(d) the heavy chain variable region CDR1, CDR2, and CDR3 comprises SEQ ID NOs: 26, 31, and 42, respectively, and the light chain variable region CDR1, CDR2, and CDR3 comprises SEQ ID NOs: 50, 52, and 54, respectively;
(e) the heavy chain variable region CDR1, CDR2, and CDR3 comprises SEQ ID NOs: 27, 32, and 43, respectively, and the light chain variable region CDR1, CDR2, and CDR3 comprises SEQ ID NOs: 50, 52, and 55, respectively;
(f) the heavy chain variable region CDR1, CDR2, and CDR3 comprises SEQ ID NOs: 27, 32, and 43, respectively, and the light chain variable region CDR1, CDR2, and CDR3 comprises SEQ ID NOs: 50, 52, and 57, respectively;
(g1) the heavy chain variable region CDR1, CDR2, and CDR3 comprises SEQ ID NOs: 27, 32, and 43, respectively, and the light chain variable region CDR1, CDR2, and CDR3 comprises SEQ ID NOs: 51, 53, and 56, respectively;
(g2) the heavy chain variable region CDR1, CDR2, and CDR3 comprises SEQ ID NOs: 27, 32, and 43, respectively, and the light chain variable region CDR1, CDR2, and CDR3 comprises SEQ ID NOs: 50, 52, and 57, respectively;
(g3) the heavy chain variable region CDR1, CDR2, and CDR3 comprises SEQ ID NOs: 27, 32, and 43, respectively, and the light chain variable region CDR1, CDR2, and CDR3 comprises SEQ ID NOs: 50, 52, and 55, respectively;
(h) the heavy chain variable region CDR1, CDR2, and CDR3 comprises SEQ ID NOs: 27, 33, and 44, respectively, and the light chain variable region CDR1, CDR2, and CDR3 comprises SEQ ID NOs: 50, 52, and 54 respectively; or
(i) the heavy chain variable region CDR1, CDR2, and CDR3 comprises SEQ ID NOs: 27, 34, and 45, respectively, and the light chain variable region CDR1, CDR2, and CDR3 comprises SEQ ID NOs: 50, 52, and 55, respectively;
wherein the antibody specifically binds to human TIM3.

In some embodiments, anti-TIM3 antibodies useful for the present disclosure comprises a VH CDR1, VH CDR2, VH CDR3, VL CDR1, VL CDR2, and/or VL CDR3 that differs from the corresponding CDR of 13A3, 3G4, 17C3, 17C8, 9F6, 8B9, 8C4 or any of TIM3.2 to TIM3.18 in 1, 2, 3, 4, 5, 1-2, 1-3, 1-4, or 1-5 amino acid changes (i.e., amino acid substitutions, additions or deletions). In certain embodiments, an anti-TIM3 antibody useful for the disclosure comprises 1-5 amino acid changes in each of 1, 2, 3, 4, 5 or 6 of the CDRs relative to the corresponding sequence in 13A3, 3G4, 17C3, 17C8, 9F6, 8B9, 8C4 or any of TIM3.2 to TIM3.18. In certain embodiments, an anti-TIM3 antibody comprises at total of 1-5 amino acid changes across all CDRs relative to the CDRs in 13A3, 3G4, 17C3, 17C8, 9F6, 8B9, 8C4 or any of TIM3.2 to TIM3.18.

In certain embodiments, an anti-TIM3 antibody comprises VH and VL CDRs consisting of those of 13A3, wherein one or more of the amino acids in one or more CDRs are those of one of the other anti-TIM3 antibodies disclosed herein.

For example, in certain embodiments, an anti-TIM3 antibody comprises a VH CDR1 comprising one or more amino acid modifications relative to SRSYYWG (SEQ ID NO: 23), and can comprise, e.g., the following degenerate sequence: $X_1X_2X_3X_4YX_5X_6$ (SEQ ID NO: 211), wherein $X_1$ is any amino acid, e.g., S or none; $X_2$ is any amino acid, e.g., R or none; $X_3$ is any amino acid, e.g., S, R, or D; $X_4$ is any amino acid, e.g., Y or H; $X_5$ is any amino acid, e.g., W or M; and $X_6$ is any amino acid, e.g., G, N, S, or H.

In certain embodiments, an anti-TIM3 antibody comprises a VH CDR2 comprising one or more amino acid modifications relative to SIYYSGFTYYNPSLKS (SEQ ID NO: 28), and can comprise, e.g., the following degenerate sequence: $X_1IX_2X_3X_4GX_5X_6X_7X_8YX_9X_{10}X_{11}X_{12}X_{13}X_{14}$ (SEQ ID NO: 212), wherein $X_1$ is any amino acid, e.g., S, Y, I, or F; $X_2$ is any amino acid, e.g., Y, H, N, or S; X3 is any amino acid, e.g., Y, P, G, T, or S; X4 is any amino acid, e.g., S, T, R, or G; X5 is any amino acid, e.g., F, S, or D; X6 is any amino acid, e.g., S, T, or I; X7 is any amino acid, e.g., I or none; X8 is any amino acid, e.g., Y, N, or I; X9 is any amino acid, e.g., N, Q, S, or A; X10 is any amino acid, e.g., P, S, Q, or D; X11 is any amino acid, e.g., S or K; X12 is any amino acid, e.g., L, F, or V; X13 is any amino acid, e.g., K or Q; and X14 is any amino acid, e.g., S or G.

In certain embodiments, an anti-TIM3 antibody comprises a VH CDR3 comprising one or more amino acid modifications relative to GGPYGDYAHWFDP (SEQ ID NO: 39), and can comprise, e.g., the following degenerate sequence: $X_1X_2X_3X_4X_5X_6X_7X_8X_9X_{10}YGX_{11}X_{12}X_{13}X_{14}X_{15}X_{16}X_{17}X_{18}$ (SEQ ID NO: 213), wherein $X_1$ is any amino acid, e.g., D, E, or none; $X_2$ is any amino acid, e.g., F, G, or none; X3 is any amino acid, e.g., Y or none; X4 is any amino acid, e.g., G, S, or none; X5 is any amino acid, e.g., G, T, or S; X6 is any amino acid, e.g., G or S; X7 is any amino acid, e.g., N, W, or none; X8 is any amino acid, e.g., Y, S, E, or none; X9 is any amino acid, e.g., Y or none; X10 is any amino acid, e.g., P or Y; X11 is any amino acid, e.g., D or none; X12 is any amino acid, e.g., Y or none; X13 is any amino acid, e.g., A or none; X14 is any amino acid, e.g., H or none; X15 is any amino acid, e.g., W or none; X16 is any amino acid, e.g., F or M; X17 is any amino acid, e.g., D or E; and X18 is any amino acid, e.g., P, I, V, Y, or L.

A VH domain, or one or more CDRs thereof, of the anti-TIM3 antibodies suitable for the present disclosure can be linked to a constant domain for forming a heavy chain, e.g., a full length heavy chain. Similarly, a VL domain, or one or more CDRs thereof, described herein can be linked to a constant domain for forming a light chain, e.g., a full length light chain. A full length heavy chain (optionally lacking the C-terminal lysine (K) residue or the C-terminal glycine and lysine (GK) residues) and full length light chain combine to form a full length antibody.

A VH domain of the anti-TIM3 antibodies can be fused to the constant domain of a human IgG, e.g., IgG1, IgG2, IgG3 or IgG4, which are either naturally-occurring or modified, e.g., as further described herein. For example, a VH domain can comprise the amino acid sequence of any VH domain described herein fused to a human IgG, e.g., an IgG1, constant region, such as the following wild-type human IgG1 constant domain amino acid sequence:

```
                                          (SEQ ID NO: 58)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSRDELTKNQ

VSLTCLVKGFYPSDIAVEWESNGQPENNYKTTPPVLDSDGSFFLYSKLT

VDKSRWQQGNVFSCSVMHEALHNHYTQKSLSLSPGK
``` or that of an allotypic variant of SEQ ID NO: 58 and have the following amino acid sequences:

```
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK (SEQ ID NO:

59; allotype specificamino acid residues are in bold and underlined)
```

A VH domain of the anti-TIM3 antibodies can comprise the amino acid sequence of any VH domain described herein fused to an effectorless constant region, e.g., the following effectorless human IgG1 constant domain amino acid sequences:

```
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPEAEGAPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPSSIEKTISKAKGQPREPQVYTLPPSREEMTKNQ

VSLTCLVKGFYPSDIAVEWESNGQPENNYKTTPPVLDSDGSFFLYSKLT

VDKSRWQQGNVESCSVMHEALHNHYTQKSLSLSPGK (SEQ ID NO:

60; "IgG1.1f," comprising substitutions L234A,

L235E, G237A, A330S and P331S, whichare underlined);
or

ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPEAEGAPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVESCSVMHEALHNHYTQKSLSLSPGK (SEQ ID NO:

61; "IgG1.3f", comprising substitutions L234A,

L235E and G237A, which are underlined)
```

For example, an allotypic variant of IgG1 comprises an K97R, D239E, and/or L241M (underlined and bolded above) and numbering according to that in SEQ ID NOs: 59-61. Within the full length heavy region, e.g., 8C4 (SEQ ID NO: 70) and according to EU numbering, these amino acid substitutions are numbered K214R, D356E, and L358M. In some embodiments, the constant region of an anti-TIM3 antibody can comprise one or more mutations or substitutions at amino acids L117, A118, G120, A213, and P214 (underlined above) as numbered in SEQ ID NO:

59-61, or L234, A235, G237, A330 and P331, per EU numbering. In further embodiments, the constant region of an anti-TIM3 antibody comprises one or more mutations or substitutions at amino acids L117A, A118E, G120A, A213S, and P214S of SEQ ID NO: 58, or L234A, L235E, G237A, A330S and P331S, per EU numbering. The constant region of an anti-TIM3 antibody may also comprise one or more mutations or substitutions L117A, A118E and G120A of SEQ ID NO: 58, or L234A, L235E and G237A, per EU numbering.

Alternatively, a VH domain of the anti-TIM3 antibodies can comprise the amino acid sequence of any VH domain described herein fused to a human IgG4 constant region, e.g., the following human IgG4 amino acid sequence or variants thereof:

ASTKGPSVFPLAPCSRSTSESTAALGCLVKDYFPEPVTVSWNSGALTSG

VHTFPAVLQSSGLYSLSSVVTVPSSSLGTKTYTCNVDHKPSNTKVDKRV

ESKYGPPCPSCPAPEFLGGPSVFLFPPKPKDTLMISRTPEVTCVVVDVS

QEDPEVQFNWYVDGVEVHNAKTKPREEQFNSTYRVVSVLTVLHQDWLNG

KEYKCKVSNKGLPSSIEKTISKAKGQPREPQVYTLPPSQEEMTKNQVSL

TCLVKGFYPSDIAVEWESNGQPENNYKTTPVLDSDGSFFLYSRLTVDKS

RWQEGNVFSCSVMHEALHNHYTQKSLSLSLGK (SEQ ID NO: 63, comprising S228P).

A VL domain of the anti-TIM3 antibodies can be fused to the constant domain of a human Kappa or Lambda light chain. For example, a VL domain of an anti-TIM3 antibody can comprise the amino acid sequence of any VL domain described herein fused to the following human IgG1 kappa light chain amino acid sequence:

(SEQ ID NO: 64)
RTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPV
TKSFNRGEC

In certain embodiments, the heavy chain constant region of the anti-TIM3 antibodies comprises a lysine or another amino acid at the C-terminus, e.g., it comprises the following last amino acids: LSPGK (SEQ ID NO: 65) in the heavy chain. In certain embodiments, the heavy chain constant region is lacking one or more amino acids at the C-terminus, and has, e.g., the C-terminal sequence LSPG (SEQ ID NO: 66) or LSP (SEQ ID NO: 67).

The amino acid sequences of heavy and light chains of exemplary anti-TIM3 antibodies correspond to SEQ ID NOs: 68-189 for the heavy chains and SEQ ID NOs: 190-193 for the light chains.

In certain embodiments, the anti-TIM3 antibodies suitable for the present disclosure comprise:
(a1) heavy and light chain sequences comprising SEQ ID NOs: 136 (or 137) and 190, respectively;
(a2) heavy and light chain sequences comprising SEQ ID NOs: 68 (or 75) and 190, respectively;
(a3) heavy and light chain sequences comprising SEQ ID NOs: 82 (or 89)) and 190, respectively;
(a4) heavy and light chain sequences comprising SEQ ID NOs: 138 (or 139) and 190, respectively;
(a5) heavy and light chain sequences comprising SEQ ID NOs: 96 (or 106) and 190, respectively;
(a6) heavy and light chain sequences comprising SEQ ID NOs: 116 (or 126) and 190, respectively;
(a7) heavy and light chain sequences comprising SEQ ID NOs: 140 (or 141) and 190, respectively;
(a8) heavy and light chain sequences comprising SEQ ID NOs: 97 (or 107) and 190, respectively;
(a9) heavy and light chain sequences comprising SEQ ID NOs: 117 (or 127) and 190, respectively;
(a10) heavy and light chain sequences comprising SEQ ID NOs:142 (or 143) and 190, respectively;
(a11) heavy and light chain sequences comprising SEQ ID NOs: 98 (or 108) and 190, respectively;
(a12) heavy and light chain sequences comprising SEQ ID NOs: 118 (or 128) and 190, respectively;
(a13) heavy and light chain sequences comprising SEQ ID NOs: 144 (or 145) and 190, respectively;
(a14) heavy and light chain sequences comprising SEQ ID NOs: 99 (or 109) and 190, respectively;
(a15) heavy and light chain sequences comprising SEQ ID NOs: 119 (or 129) and 190, respectively;
(a16) heavy and light chain sequences comprising SEQ ID NOs: 146 (or 147) and 190, respectively;
(a17) heavy and light chain sequences comprising SEQ ID NOs: 100 (or 110) and 190, respectively;
(a18) heavy and light chain sequences comprising SEQ ID NOs: 120 (or 130) and 190, respectively;
(a19) heavy and light chain sequences comprising SEQ ID NOs:148 (or 149) and 190, respectively;
(a20) heavy and light chain sequences comprising SEQ ID NOs: 101 (or 111) and 190, respectively;
(a21) heavy and light chain sequences comprising SEQ ID NOs: 121 (or 131) and 190, respectively;
(a22) heavy and light chain sequences comprising SEQ ID NOs: 150 (or 151) and 190, respectively;
(a23) heavy and light chain sequences comprising SEQ ID NOs: 102 (or 112) and 190, respectively;
(a24) heavy and light chain sequences comprising SEQ ID NOs: 122 (or 132) and 190, respectively;
(a25) heavy and light chain sequences comprising SEQ ID NOs: 152 (or 153) and 190, respectively;
(a26) heavy and light chain sequences comprising SEQ ID NOs: 103 (or 113) and 190, respectively;
(a27) heavy and light chain sequences comprising SEQ ID NOs: 123 (or 133) and 190, respectively;
(a28) heavy and light chain sequences comprising SEQ ID NOs: 154 (or 155) and 190, respectively;
(a29) heavy and light chain sequences comprising SEQ ID NOs: 184 (or 185) and 190, respectively;
(a30) heavy and light chain sequences comprising SEQ ID NOs: 186 (or 187) and 190, respectively;
(a31) heavy and light chain sequences comprising SEQ ID NOs: 188 (or 189) and 190, respectively;
(b1) heavy and light chain sequences comprising SEQ ID NOs: 156 (or 157) and 191, respectively;
(b2) heavy and light chain sequences comprising SEQ ID NOs: 69 (or 76) and 191, respectively;
(b3) heavy and light chain sequences comprising SEQ ID NOs: 83 (or 90) and 191, respectively;
(b4) heavy and light chain sequences comprising SEQ ID NOs:158 (or 159) and 191, respectively;
(b5) heavy and light chain sequences comprising SEQ ID NOs: 104 (or 114) and 191, respectively;
(b6) heavy and light chain sequences comprising SEQ ID NOs: 124 (or 134) and 191, respectively;
(b7) heavy and light chain sequences comprising SEQ ID NOs: 160 (or 161) and 191, respectively;

(c1) heavy and light chain sequences comprising SEQ ID NOs: 162 (or 163) and 191, respectively;
(c2) heavy and light chain sequences comprising SEQ ID NOs: 70 (or 77) and 191, respectively;
(c3) heavy and light chain sequences comprising SEQ ID NOs: 84 (or 91) and 191, respectively;
(c4) heavy and light chain sequences comprising SEQ ID NOs: 164 (or 165) and 191, respectively;
(d1) heavy and light chain sequences comprising SEQ ID NOs: 166 (or 167) and 190, respectively;
(d2) heavy and light chain sequences comprising SEQ ID NOs: 71 (or 78) and 190, respectively;
(d3) heavy and light chain sequences comprising SEQ ID NOs: 85 (or 92) and 190, respectively;
(d4) heavy and light chain sequences comprising SEQ ID NOs: 168 (or 169) and 190, respectively;
(e1.1) heavy and light chain sequences comprising SEQ ID NOs: 170 (or 171) and 192, respectively;
(e1.2) heavy and light chain sequences comprising SEQ ID NOs: 170 (or 171) and 193, respectively;
(e1.3) heavy and light chain sequences comprising SEQ ID NOs: 170 (or 171) and 191, respectively;
(e2) heavy and light chain sequences comprising SEQ ID NOs: 72 (or 79) and 193, respectively;
(e3) heavy and light chain sequences comprising SEQ ID NOs: 86 (or 93) and 193, respectively;
(e4) heavy and light chain sequences comprising SEQ ID NOs: 172 (or 173) and 193, respectively;
(e5) heavy and light chain sequences comprising SEQ ID NOs: 105 (or 115) and 193, respectively;
(e6) heavy and light chain sequences comprising SEQ ID NOs: 125 (or 135) and 193, respectively;
(e7) heavy and light chain sequences comprising SEQ ID NOs: 174 (or 175) and 193, respectively;
(f1) heavy and light chain sequences comprising SEQ ID NOs: 176 (or 177) and 190, respectively;
(f2) heavy and light chain sequences comprising SEQ ID NOs: 73 (or 80) and 190, respectively;
(f3) heavy and light chain sequences comprising SEQ ID NOs: 87 (or 94) and 190, respectively;
(f4) heavy and light chain sequences comprising SEQ ID NOs: 178 (or 179) and 190, respectively;
(g1) heavy and light chain sequences comprising SEQ ID NOs: 180 (or 181) and 191, respectively;
(g2) heavy and light chain sequences comprising SEQ ID NOs: 74 (or 81) and 191, respectively;
(g3) heavy and light chain sequences comprising SEQ ID NOs: 88 (or 95) and 191, respectively; or
(g4) heavy and light chain sequences comprising SEQ ID NOs: 182 (or 183) and 191, respectively;
wherein the antibody specifically binds to human TIM3.

The nucleic acid sequences encoding the heavy chain sequences of the TIM3 antibodies disclosed herein (e.g., in the preceding paragraph) are provided as SEQ ID NOs: 214-241, 247-291, 294-297. The nucleic acid sequences encoding the light chain sequences of the TIM3 antibodies disclosed herein (e.g., in the preceding paragraph) are provided as SEQ ID NOs:242-246 and 299.

In some embodiments, an anti-TIM3 antibody comprises a combination of a heavy and light chain sequences set forth herein, e.g., in the preceding paragraph, wherein the antibody comprises two heavy chains and two light chains, and can further comprise at least one disulfide bond linking the two heavy chains together. The antibodies can also comprise disulfide bonds linking each of the light chains to each of the heavy chains.

In other embodiments, the anti-TIM3 antibodies are human antibodies, humanized antibodies, or chimeric antibodies. In some embodiments, the anti-TIM3 antibodies bind to a conformational epitope. In other embodiments, the anti-TIM3 antibodies bind to amino acid residues within the following region of mature human TIM3 extracellular domain (SEQ ID NO: 198): SEVEYRAEVGQNAYLPCFYTPAAPGNLVPVCWGKGACPVFECGNVVLRTDERDVNYWTSRYWLNGDFRKGDVSLT IENVTLADSGIYCCRIQIPGIMND (SEQ ID NO: 203), corresponding to amino acid residues 1-99 of mature human TIM3 extracellular domain (SEQ ID NO: 198) or amino acids 22 to 120 of human TIM3 having SEQ ID NO: 194.

In some embodiments, the anti-TIM3 antibodies described herein bind to amino acid residues within the following region of mature human TIM3 extracellular domain (SEQ ID NO: 198): CPVFECG (SEQ ID NO: 200), corresponding to amino acid residues 37-43 of mature human TIM3 extracellular domain (SEQ ID NO: 198).

In some embodiments, the anti-TIM3 antibodies bind to amino acid residues within the following region of mature human TIM3 extracellular domain (SEQ ID NO: 198): WTSRYWLNGDFR (SEQ ID NO: 201), corresponding to amino acid residues 57-83 of mature human TIM3 extracellular domain (SEQ ID NO: 198).

In some embodiments, the anti-TIM3 antibodies bind to amino acid residues within the following region of mature human TIM3 extracellular domain (SEQ ID NO: 198): RIQIPGIMND (SEQ ID NO: 202), corresponding to amino acid residues 90-99 of mature human TIM3 extracellular domain (SEQ ID NO: 198).

In some embodiments, the anti-TIM3 antibodies have the same pattern of binding to wildtype and mutated human TIM3 as that of one or more of antibodies 13A3, 3G4, 17C3, 17C8, 9F6, 8B9, 8C4 and TIM3.2 to TIM3.18. In some embodiments, the anti-TIM3 antibodies bind to amino acid residues within the following regions of mature human TIM3 extracellular domain (SEQ ID NO: 198): CPVFECG (SEQ ID NO: 200), WTSRYWLNGDFRKGDVSLTIENVTLAD (SEQ ID NO: 201), and/or RIQIPGIMND (SEQ ID NO: 202).

In certain embodiments, an anti-TIM3 antibody binds to (1) $^{49}$VPVCWGKGACPVFE$^{62}$ (SEQ ID NO: 204) and $^{111}$RIQIPGIMNDEKFNLKL$^{127}$ (SEQ ID NO: 205) or (2) $^{40}$YTPAAPGNLVPVCWGKGACPVFE62 (SEQ ID NO: 206), $^{66}$VVLRTDERDVNY$^{77}$ (SEQ ID NO: 207), $^{78}$WTSRYWLNGDFRKGDVSL95 (SEQ ID NO: 208), $^{110}$CRIQIPGIMNDEKFNLKL$^{127}$ (SEQ ID NO: 209), and $^{119}$NDEKFNLKL$^{127}$ (SEQ ID NO: 210), as determined by HDX-MS. In certain embodiments, an anti-TIM3 antibody interacts with regions of amino acid residues 40-62 and 111-127 of hTIM3, but does not significantly interact with other regions, such as the region that is N-terminal to amino acid residue Y40, the region that is located between amino acid residues E62 and R111, and the region that is C-terminal to amino acid residue L127, as determined by HDX-MS.

In some embodiments, an anti-TIM3 antibody has reduced binding to human TIM3 in which one or more of amino acids L48, C58, P59, V60, F61, E62, C63, G64, W78, S80, R81, W83, L84, G86, D87, R89, D104, R111, Q113, G116, M118, and D120 (as numbered in SEQ ID NO: 194) is substituted with another amino acid relative to binding to wildtype human TIM3 and the antibody binds to (1) $^{49}$VPVCWGKGACPVFE$^{62}$ (SEQ ID NO: 204) and $^{111}$RIQIPGIMNDEKFNLKL$^{127}$ (SEQ ID NO: 205) or (2) $^{40}$YTPAAPGNLVPVCWGKGACPVFE$^{62}$ (SEQ ID NO: 206), $^{66}$VVLRTDERDVNY$^{77}$ (SEQ ID NO: 207), $^{78}$WTSRYWLNGDFRKGDVSL$^{95}$ (SEQ ID NO: 208), $^{110}$CRIQIPGIMNDEKFNLKL$^{127}$ (SEQ ID NO: 209), and $^{119}$NDEKFNLKL$^{127}$ (SEQ ID NO: 210), as determined by HDX-MS.

In some embodiments, an anti-TIM3 antibody has a similar pattern of binding to wild-type and mutated human TIM3 as that of TIM3.18.IgG1.3 or 13A3, i.e., the antibody:

(i) binds to (1) $^{49}$VPVCWGKGACPVFE$^{62}$ (SEQ ID NO: 204), $^{111}$RIQIPGIMNDEKFNLKL$^{127}$ (SEQ ID NO: 205), and $^{119}$NDEKFNLKL$^{127}$ (SEQ ID NO: 210), and, e.g., but does not bind significantly to (a) peptides having sequences located N-terminal of amino acid residue 49; (b) peptides having sequences located between amino acid residue 62 and 111 (e.g., $^{78}$WTSRYWLNGDFRKGDVSL$^{95}$ (SEQ ID NO: 208)); and (c) peptides having sequences that are located C-terminal of amino acid residue 127, as determined by HDX-MS;

(ii) fails to bind to human TIM3, or has significantly reduced binding to human TIM3, having one or more of the following amino acid mutations, as determined, e.g., using a yeast surface display method: C58, P59, F61, E62, C63, R111, D120, and optionally D104 and Q113 (numbering per SEQ ID NO: 194); and/or (iii) has the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (numbering per SEQ ID NO: 194).

In some embodiments, an anti-TIM3 antibody comprises a heavy chain and a light chain, wherein the heavy chain is selected from the group consisting of SEQ ID NOs: 68-189 and the light chain is selected from the group consisting of SEQ ID NOs: 190-193.

As further discussed herein, the heavy chain constant region of anti-TIM3 antibodies described herein can be of any isotype, e.g., IgG1, IgG2, IgG3 and IgG4, or combinations thereof and/or modifications thereof. An anti-TIM3 antibody can have effector function or can have reduced or no effector function. In certain embodiments, anti-TIM3 antibodies comprise a modified heavy chain constant region that provides enhanced properties to the antibody.

Additional TIM3 antagonists that can be used in the methods described herein include MBG-453, TSR-022, TRL-6061, BGBA425, LY-3321367, and any other TIM3 inhibitors, e.g., antibodies, peptides, small molecules, and bispecific molecules, such as bispecific antibodies (e.g., anti-TIM3/anti-PD-1 bispecific molecules). TIM-3 antagonists are described, e.g., in WO 2011/155607, WO 2011/159877, WO 2013/006490, CN 2010/4592388, WO 2015/109931, WO 2015/117002, WO 2016/068803, WO 2016/068802, WO 2016/071448, WO 2016/111947, WO 2016/144803, WO 2016/161270, WO 2017/019897, US 2017/0029485, WO 2017/031242, WO 2017/055399, WO 2017/055404, WO 2017/079112, WO 2017/079115, WO 2017/079116, PCT Appl. No. PCT/US2017/041946, and/or CN 2010/6632675.

PD-1 Antagonists

In one aspect, the present disclosure feature methods of using a TIM3 antagonist in combination a PD-1 antagonist. As used herein, PD-1 antagonists include, but are not limited to, PD-1 binding agents, PD-L1 binding agent, and PD-L2 binding agents. PD-1 binding agents include antibodies that specifically bind to PD-1. PD-L1 and PD-L2 binding agents include antibodies that specifically bind to PD-L1 and/or PD-L2, as well as soluble PD-1 polypeptides that bind to PD-L1 and/or PD-L2.

Anti-PD-1 Antibodies

Certain aspects of the present disclosure comprise administering to a subject in need thereof a therapeutically effective amount of an anti-PD-1 antibody, or an antigen-binding portion thereof. Human antibodies (HuMabs) that bind specifically to PD-1 with high affinity have been disclosed in U.S. Pat. No. 8,008,449. Other anti-PD-1 mAbs have been described in, for example, U.S. Pat. Nos. 6,808,710, 7,488,802, 8,168,757 and 8,354,509, and PCT Publication No. WO 2012/145493. Each of the anti-PD-1 HuMAbs disclosed in U.S. Pat. No. 8,008,449 has been demonstrated to exhibit one or more of the following characteristics: (a) binds to human PD-1 with a KD of $1 \times 10^{-7}$ M or less, as determined by surface plasmon resonance using a Biacore biosensor system; (b) does not substantially bind to human CD28, CTLA-4 or ICOS; (c) increases T-cell proliferation in a Mixed Lymphocyte Reaction (MLR) assay; (d) increases interferon-γ production in an MLR assay; (e) increases IL-2 secretion in an MLR assay; (f) binds to human PD-1 and cynomolgus monkey PD-1; (g) inhibits the binding of PD-L1 and/or PD-L2 to PD-1; (h) stimulates antigen-specific memory responses; (i) stimulates antibody responses; and (j) inhibits tumor cell growth in vivo. Anti-PD-1 Abs usable in the present invention include mAbs that bind specifically to human PD-1 and exhibit at least one, in some embodiments, at least five, of the preceding characteristics. In some embodiments, the anti-PD-1 antibody is nivolumab (OPDIVO®). In some embodiments, the anti-PD-1 antibody is pembrolizumab (KEYTRUDA®).

In some embodiments, the anti-PD-1 antibody is nivolumab. Nivolumab (also known as "OPDIVO®"; formerly designated 5C4, BMS-936558, MDX-1106, or ONO-4538) is a fully human IgG4 (S228P) PD-1 immune checkpoint inhibitor antibody that selectively prevents interaction with PD-1 ligands (PD-L1 and PD-L2), thereby blocking the down-regulation of antitumor T-cell functions (U.S. Pat. No. 8,008,449; Wang et al., 2014 *Cancer Immunol Res.* 2(9): 846-56).

In some embodiments, the anti-PD-1 antibody is pembrolizumab. Pembrolizumab (also known as "KEYTRUDA®", lambrolizumab, and MK-3475) is a humanized monoclonal IgG4 antibody directed against human cell surface receptor PD-1 (programmed death-1 or programmed cell death-1). Pembrolizumab is described, for example, in U.S. Pat. Nos. 8,354,509 and 8,900,587; see also www.cancer.gov/drugdictionary?cdrid=695789 (last accessed: Dec. 14, 2014). Pembrolizumab has been approved by the FDA for the treatment of relapsed or refractory melanoma.

In other embodiments, the anti-PD-1 antibody or fragment thereof cross-competes with MEDI0608. In still other embodiments, the anti-PD-1 antibody or fragment thereof binds to the same epitope as MEDI0608. In certain embodiments, the anti-PD-1 antibody has the same CDRs as MEDI0608. In other embodiments, the anti-PD-1 antibody is MEDI0608 (formerly AMP-514), which is a monoclonal antibody. MEDI0608 is described, for example, in U.S. Pat. No. 8,609,089B2.

In certain embodiments, the PD-1 antagonist is AMP-224, which is a B7-DC Fc fusion protein. AMP-224 is discussed in U.S. Publ. No. 2013/0017199 and in worldwideweb.cancer.gov/publications/dictionaries/cancer-drug?cdrid=700595 (last accessed Jul. 8, 2015).

In certain embodiments, the anti-PD-1 antibody is BGB-A317, which is a humanized monoclonal antibody. BGB-A317 is described in U.S. Publ. No. 2015/0079109.

Anti-PD-1 antibodies usable in the disclosed methods also include isolated Abs that bind specifically to human PD-1 and cross-compete for binding to human PD-1 with nivolumab (see, e.g., U.S. Pat. Nos. 8,008,449 and 8,779,105; WO 2013/173223). The ability of Abs to cross-compete for binding to an antigen indicates that these Abs bind to the same epitope region of the antigen and sterically hinder the binding of other cross-competing Abs to that particular epitope region. These cross-competing Abs are expected to have functional properties very similar those of nivolumab by virtue of their binding to the same epitope region of PD-1. Cross-competing Abs can be readily identified based on their ability to cross-compete with nivolumab in standard PD-1 binding assays such as Biacore analysis, ELISA assays or flow cytometry (see, e.g., WO 2013/173223).

In certain embodiments, the antibodies that cross-compete for binding to human PD-1 with, or bind to the same epitope region of human PD-1 antibody, nivolumab, are monoclonal antibodies. For administration to human subjects, these cross-competing antibodies are chimeric antibodies, or humanized or human Abs. Such chimeric, humanized or human monoclonal antibodies can be prepared and isolated by methods well known in the art.

Anti-PD-1 Abs usable in the methods of the disclosed invention also include antigen-binding portions of the above antibodies. It has been amply demonstrated that the antigen-binding function of an antibody can be performed by fragments of a full-length antibody. Examples of binding fragments encompassed within the term "antigen-binding portion" of an antibody include (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; and (iv) a Fv fragment consisting of the VL and VH domains of a single arm of an antibody.

Anti-PD-1 antibodies suitable for use in the disclosed methods or compositions are antibodies that bind to PD-1 with high specificity and affinity, block the binding of PD-L1 and or PD-L2, and inhibit the immunosuppressive effect of the PD-1 signaling pathway. In any of the compositions or methods disclosed herein, an anti-PD-1 "antibody" includes an antigen-binding portion or fragment that binds to the PD-1 receptor and exhibits the functional properties similar to those of whole antibodies in inhibiting ligand binding and up-regulating the immune system. In certain embodiments, the anti-PD-1 antibody or antigen-binding portion thereof cross-competes with nivolumab for binding to human PD-1. In other embodiments, the anti-PD-1 antibody or antigen-binding portion thereof is a chimeric, humanized or human monoclonal antibody or a portion thereof. In certain embodiments, the antibody is a humanized antibody. In other embodiments, the antibody is a human antibody. Abs of an IgG1, IgG2, IgG3 or IgG4 isotype can be used.

In certain embodiments, the anti-PD-1 antibody or antigen-binding portion thereof comprises a heavy chain constant region that is of a human IgG1 or IgG4 isotype. In certain other embodiments, the sequence of the IgG4 heavy chain constant region of the anti-PD-1 antibody or antigen-binding portion thereof contains an S228P mutation which replaces a serine residue in the hinge region with the proline residue normally found at the corresponding position in IgG1 isotype antibodies. This mutation, which is present in nivolumab, prevents Fab arm exchange with endogenous IgG4 antibodies, while retaining the low affinity for activating Fc receptors associated with wild-type IgG4 antibodies (Wang et al., 2014 Cancer Immunol Res. 2(9):846-56). In yet other embodiments, the antibody comprises a light chain constant region that is a human kappa or lambda constant region. In other embodiments, the anti-PD-1 antibody or antigen-binding portion thereof is a mAb or an antigen-binding portion thereof. In certain embodiments of any of the therapeutic methods described herein comprising administration of an anti-PD-1 antibody, the anti-PD-1 antibody is nivolumab. In other embodiments, the anti-PD-1 antibody is pembrolizumab. In other embodiments, the anti-PD-1 antibody is chosen from the human antibodies 17D8, 2D3, 4H1, 4A11, 7D3 and 5F4 described in U.S. Pat. No. 8,008,449. In still other embodiments, the anti-PD-1 antibody is MEDI0608 (formerly AMP-514), AMP-224, PDR001, or BGB-A317.

Anti-PD-L1 Antibodies

In certain embodiments, an anti-PD-1 antibody used in the methods can be replaced with another PD-1 or anti-PD-L1 antagonist. For example, because an anti-PD-L1 antibody prevents interaction between PD-1 and PD-L1, thereby exerting similar effects to the signaling pathway of PD-1, an anti-PD-L1 antibody can replace the use of an anti-PD-1 antibody in the methods disclosed herein. Therefore, certain aspects of the present disclosure comprise administering to a subject in need thereof a therapeutically effective amount of an anti-PD-L1 antibody or an antigen binding portion thereof. In certain embodiments, the anti-PD-L1 antibody useful for the method is BMS-936559 (formerly 12A4 or MDX-1105) (see, e.g., U.S. Pat. No. 7,943,743; WO 2013/173223). In other embodiments, the anti-PD-L1 antibody is MPDL3280A (also known as RG7446) (see, e.g., Herbst et al. (2013) *J Clin Oncol* 31(suppl):3000. Abstract; U.S. Pat. No. 8,217,149), MEDI4736 (also called durvalumab (IMFINZI®); Khleif (2013) In: Proceedings from the European Cancer Congress 2013; Sep. 27-Oct. 1, 2013; Amsterdam, The Netherlands. In certain embodiments, the antibodies that cross-compete for binding to human PD-L1 with, or bind to the same epitope region of human PD-L1 as the above-references PD-L1 antibodies are mAbs. In certain embodiments, the anti-PD-L1 antibody or the antigen binding portion thereof competes for binding with BMS-936559, MPDL3280A, MEDI4736, or MSB0010718C for binding to human PD-L1. For administration to human subjects, these cross-competing antibodies can be chimeric antibodies, or can be humanized or human antibodies. Such chimeric, humanized or human mAbs can be prepared and isolated by methods well known in the art. See U.S. Pat. No. 8,779,108 or US 2014/0356353, filed May 6, 2014), or MSB0010718C (also called avelumab (BAVENCIO®)); See US 2014/0341917). In certain embodiments, the anti-PD-L1 antibody or antigen-binding portion thereof comprises a heavy chain constant region which is of a human IgG1 or IgG4 isotype. In some embodiments, the anti-PD-L1 antibody is BMS-936559. In some embodiments, the anti-PD-L1 antibody is MPDL3280A (atezolizumab (TECENTRIQ®)). In some embodiments, the anti-PD-L1 antibody is MEDI4736 (durvalumab (IMFINZI®)). In some embodiments, the anti-PD-L1 antibody is MSB0010718C (avelumab (BAVENCIO®)).

Pharmaceutical Compositions

Pharmaceutical compositions suitable for administration to human patients are typically formulated for parenteral administration, e.g., in a liquid carrier, or suitable for reconstitution into liquid solution or suspension for intravenous administration.

In general, such compositions typically comprise a pharmaceutically acceptable carrier. As used herein, the term "pharmaceutically acceptable" means approved by a government regulatory agency or listed in the U.S. Pharmacopeia or another generally recognized pharmacopeia for use in animals, particularly in humans. The term "carrier" refers to a diluent, adjuvant, excipient, or vehicle with which the compound is administered. Such pharmaceutical carriers can be sterile liquids, such as water and oils, including those of petroleum, animal, vegetable or synthetic origin, such as peanut oil, soybean oil, mineral oil, sesame oil, glycerol polyethylene glycol ricinoleate, and the like. Water or aqueous solution saline and aqueous dextrose and glycerol solutions may be employed as carriers, particularly for injectable solutions (e.g., comprising a TIM3 antagonist and/or a PD-1 antagonist). Liquid compositions for parenteral administration can be formulated for administration by injection or continuous infusion. Routes of administration by injection or infusion include intravenous, intraperitoneal, intramuscular, intrathecal and subcutaneous. In some embodiments, the TIM3 antagonist and the PD-1 antagonist are administered intravenously (e.g., in separate formulations or together (in the same formulation or in separate formulations)).

Patient Populations

Provided herein are clinical methods for treating a cancer in human patients using an immunotherapy disclosed herein, for example, a TIM3 antagonist (e.g., an anti-TIM3 antibody), alone or in conjunction with another immune checkpoint inhibitor (e.g., an anti-PD-1 antibody).

Examples of cancers that may be treated using the methods of the invention, include liver cancer, hepatocellular carcinoma (HCC), bone cancer, pancreatic cancer, skin cancer, oral cancer, cancer of the head or neck, breast cancer, lung cancer, small cell lung cancer, NSCLC, cutaneous or intraocular malignant melanoma, renal cancer, uterine cancer, ovarian cancer, colorectal cancer, colon cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, squamous cell carcinoma of the head and neck (SCCHN), non-Hodgkin's lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, environmentally induced cancers including those induced by asbestos, hematologic malignancies including, for example, multiple myeloma, B-cell lymphoma, Hodgkin lymphoma/primary mediastinal B-cell lymphoma, non-Hodgkin's lymphomas, acute myeloid lymphoma, chronic myelogenous leukemia, chronic lymphoid leukemia, follicular lymphoma, diffuse large B-cell lymphoma, Burkitt's lymphoma, immunoblastic large cell lymphoma, precursor B-lymphoblastic lymphoma, mantle cell lymphoma, acute lymphoblastic leukemia, mycosis fungoides, anaplastic large cell lymphoma, T-cell lymphoma, and precursor T-lymphoblastic lymphoma, and any combinations of said cancers. The present invention is also applicable to treatment of metastatic cancers.

In some embodiments, the subject suffers from a cancer that is refractory to treatment with an immune checkpoint inhibitor. In some embodiments, the subject suffers from a cancer that is refractory to treatment with a PD-1 antagonist (e.g., anti-PD-1 antibody or an anti-PD-L1 antibody). In some embodiments, the cancer is a solid tumor. In other embodiments, the cancer is a colon, kidney, or lung cancer.

Subjects can be tested or selected for one or more of the above described clinical attributes prior to, during or after treatment.

Immunotherapies

In one aspect, immunotherapies provided herein involve administration of a TIM3 antagonist (e.g., an anti-TIM3 antibody), alone or in conjunction with another immune checkpoint inhibitor (e.g., a PD-1 antagonist, e.g., anti-PD-1 antibody), to treat subjects having a cancer. In a particular embodiment, the TIM3 antagonist is an anti-TIM3 antibody described herein. In certain embodiments, the PD-1 antagonist is the anti-PD-1 antibody nivolumab. In some embodiments, dosage regimens are adjusted to provide the optimum desired response (e.g., an effective response).

As used herein, adjunctive or combined administration (co-administration) includes simultaneous administration of the compounds in the same or different dosage form, or separate administration of the compounds (e.g., sequential administration). Thus, for example, the TIM3 antagonist and PD-1 antagonist can be simultaneously administered in a single formulation. Alternatively, the TIM3 antagonist and the PD-1 antagonist can be formulated for separate administration and are administered concurrently or sequentially (e.g., one antibody is administered within about 30 minutes prior to administration of the second antibody).

For example, the TIM3 antagonist can be administered first followed by (e.g., immediately followed by) the administration of the PD-1 antagonist, or vice versa. In some embodiments, the PD-1 antagonist is administered prior to administration of the TIM3 antagonist. In some embodiments, the PD-1 antagonist is administered after administration of the TIM3 antagonist. In other embodiments, the TIM3 antagonist and the PD-1 antagonist are administered concurrently. Such concurrent or sequential administration preferably results in both antagonists being simultaneously present in the treated subjects.

The following examples are offered by way of illustration and not by way of limitation. The contents of all references cited throughout this application are expressly incorporated herein by reference.

EXAMPLES

Example 1

Analysis of TIM3 Expression Levels on CD4 and CD8 T Lymphocytes from Cancer Patients In order to begin assessing the suitability of using TIM3 expression to identify subjects (e.g., human cancer patients) suitable for treatment with a TIM3 antagonist, fresh tumor tissues and matching peripheral blood samples were obtained from patients with lung, kidney, or colon cancer (ConversantBio, MT Group, Benaroya) and shipped to the laboratory for analysis. The tumor tissue and blood samples were shipped overnight at 4° C. in hypothermosol FRS (Biolife Solutions) and ACD Solution A (BD Biosciences), respectively. The samples were processed and analyzed within 24 hours after collection.

Tissue Processing for Immunophenotyping

Tumor tissues were weighed and dissociated using the Miltenyi dissociation kit (Miltenyi, Catalog 130-095-929). The peripheral blood cells were treated with red blood cells (RBC) Lysis Buffer (BioLegend, Catalog 420301). Then, the cell suspensions (from tumor tissues or peripheral blood) were washed two times in HBSS (no Ca, no Mg), stained with NIR Viability Dye (Molecular Probes by Life Technologies, Catalog L34976), blocked with human AB serum in Dulbecco's phosphate-buffered saline (dPBS), and added to wells containing cocktails of antibodies (see Table 1, below) for incubation on ice in the dark for 45 minutes. The cells were then washed twice with dPBS/BSA/Na azide, fixed, and permeabilized using the FoxP3 buffer kit (BioLegend, Catalog 421403). Fluorescence minus one (FMO) controls were prepared for all antibodies and used to determine positive cell populations. Samples were acquired on the Fortessa flow cytometer (BD Biosciences) and data were analyzed using FlowJo Software (TreeStar).

Antibody Staining for Flow Cytometry Analysis

As shown in Table 1 (below), a 15-color panel was devised to examine expression of multiple markers; the focus was on TIM3 expression on CD8+ and CD4+ T cells.

TABLE 1

Antibodies Used for Immunofluorescence Staining for T Cell Subsets

| Marker | Clone | Fluorophore | Vendor | Catalog |
|---|---|---|---|---|
| Viability | — | Near IR | ThermoFisher Scientific | L10119 |
| CD45 | HI30 | AF700 | BD Biosciences | 560566 |
| CD3 | SK7 | BUV 395 | BD Biosciences | 564001 |
| CD4 | OKT4 | BV 785 | BioLegend | 317442 |
| FoxP3 | 206D | AF647 | BioLegend | 320114 |
| CD8a | SK1 | BV605 | BD Biosciences | 564116 |
| CD25 | 4E3 | PE-e610 | eBioscience | 61-0257-42 |
| PD-1 | EH12.1 | PerCP-Cy5.5 | Biolegend | 329914 |
| Tim-3 | FAB2365G | AlexaFluor488 | R&D | |

Figure 1B:
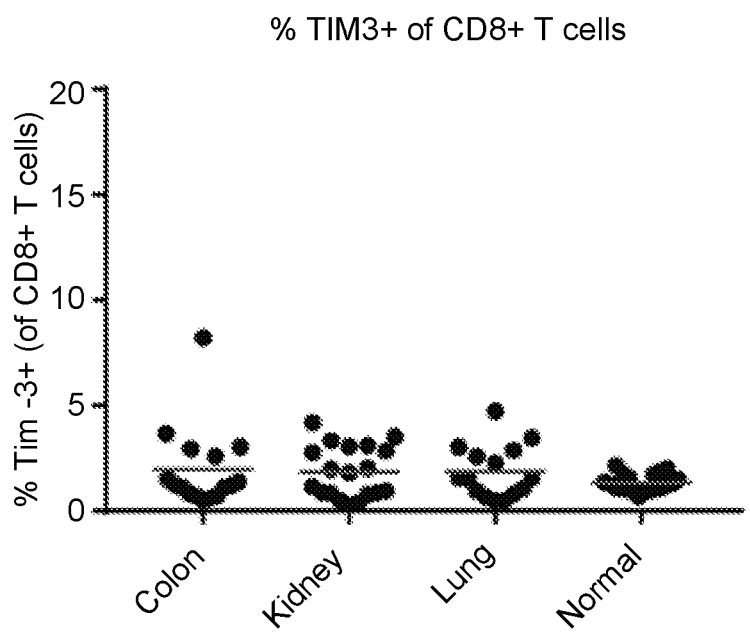
Figure 2A:
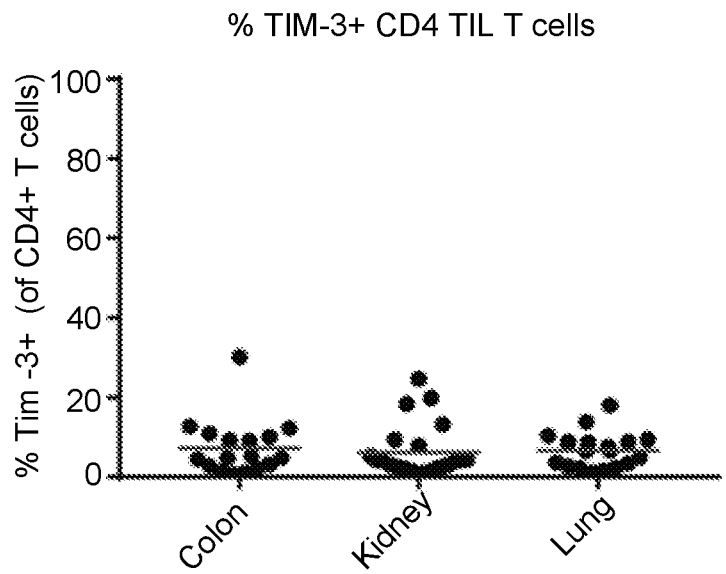
FIGS. 2A to 2E show the frequencies of CD4+ T cells and CD8+ T cells that express TIM3 and/or PD-1 in the tumor infiltrating lymphocytes (TILs) isolated from different cancer patients (i.e., colon, kidney, or lung). The frequencies of TIM3+ CD4+ and TIM3+ CD8+ T cells are shown in FIGS. 2A and 2B, respectively.
Figure 2B:
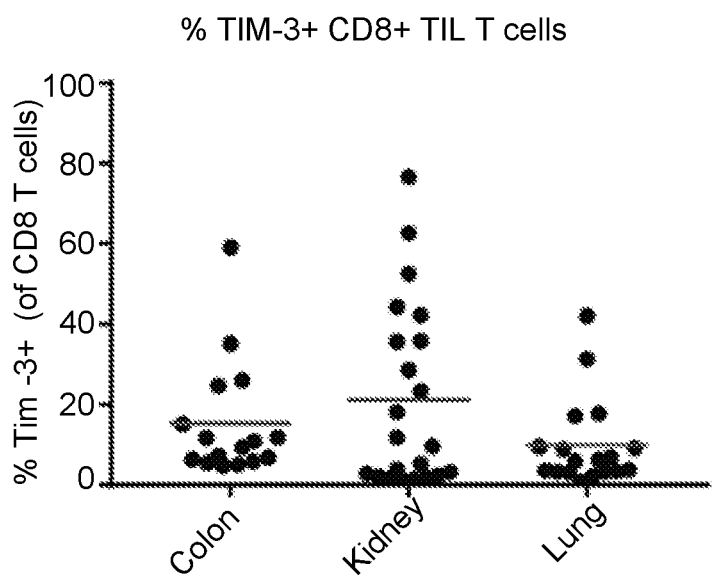

As shown in Table 2 (below) and in FIGS. 1A and 1B, very few CD4+ and CD8+ T cells expressed TIM3 in whole blood of both healthy subjects and cancer patients. The frequency of TIM3+ CD4+ was slightly higher in TILs compared to whole blood, with no major differences across the tumor types (see FIGS. 2A and 2B). Compared to CD4+ T cells, larger percentage of the CD8+ T cells were TIM3+, with mean frequencies ranging from 9.9 to 21% depending on the tumor type. RCC and to a lower extent CRC generally showed higher frequency of TIM3+ CD8 T cells than lung cancer patients. See Table 3 (below) and FIGS. 2A and 2B.

TABLE 2

Mean Frequencies ± SD of TIM3+ CD4+ and TIM3+ CD8+ T Cells in Peripheral Blood Samples from Healthy Donors and Patients with Cancer

| | Healthy (N = 20) | Lung (N = 15) | RCC (N = 19) | CRC (N = 16) |
|---|---|---|---|---|
| % TIM3+ CD4+ T cells | 1.1 ± 0.4 | 1.3 ± 0.6 | 1.4 ± 0.8 | 1.2 ± 0.6 |
| % TIM3+ CD8+ T cells | 1.3 ± 0.4 | 1.9 ± 1.3 | 1.8 ± 1.2 | 23 ± 14 |

Figure 2C:
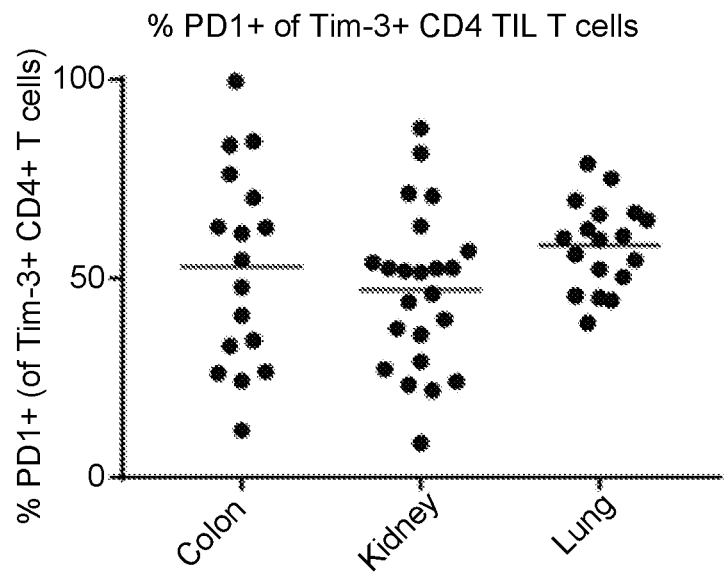
Figure 2D:
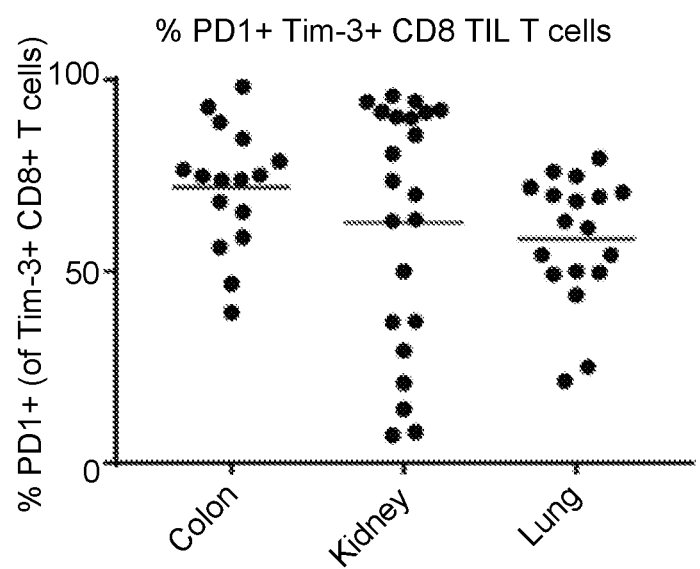
Figure 2E:
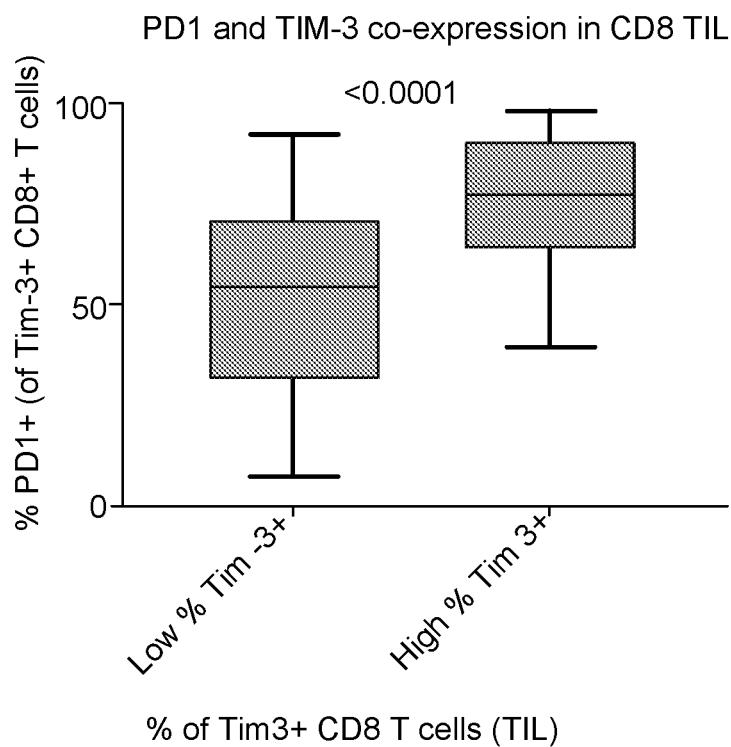

Abbreviations: N: Number of samples; SD: Standard deviation; RCC: Renal cell carcinoma; CRC; Colorectal carcinoma In addition to TIM3 expression, PD-1 expression was also assessed in the TILs described above. As shown in Table 3 (below) and FIGS. 2C and 2D, co-expression of PD-1 by TIM3+ cells varied greatly depending on patients, with patients with higher frequency of TIM3+ CD8+ T cells (i.e., at least 8%, which represented the median % TIM3+ CD8+ T cells across all three cancer types) showing higher co-expression with PD-1, as compared to patients with lower frequencies of TIM3+ CD8+ T cells (see FIG. 2E, $p<0.0001$ by Mann Whitney).

TABLE 3

Mean Frequencies ± SD of TIM3+ and PD-1+ TIM3+ CD4+ and CD8+ T Cells in TIL from Patients with Cancer

| | Lung (N = 18) | RCC (N = 23) | CRC (N = 17) |
|---|---|---|---|
| % TIM3+ CD4+ T cells | 6.7 ± 4.5 | 6.2 ± 6.6 | 7.4 ± 7.1 |
| % TIM3+ CD8+ T cells | 9.9 ± 11 | 21 ± 23 | 15 ± 15 |
| % PD-1+ (of TIM3+ CD4+ T cells) | 58 ± 11 | 47 ± 20 | 53 ± 25 |
| % PD-1+ (of TIM3+ CD8+ T cells) | 58 ± 17 | 63 ± 32 | 72 ± 16 |

Abbreviations: SD: Standard deviation; TIL: Tumor-infiltrating lymphocytes; RCC: Renal cell carcinoma; CRC: Colorectal carcinoma; N: Number of samples Example 2

Analysis of TIM3 Expression in Different T Cell Subsets

In order to assess TIM3 expression on different T cell subsets, fresh tumor tissues and matching peripheral blood samples were obtained from patients with a variety of cancer types (MT Group, CINJ): renal cell carcinoma (n=16), colorectal (n=2), liver (n=2), uterine (n=3), lung (n=1), ovarian (n=1), stomach (n=1), and gastro-intestinal (n=1). The samples were shipped to the laboratory for analysis overnight at 4° C. in hypothermosol FRS (Biolife Solutions) and on heparin (BD Biosciences), respectively. All samples were processed and stained within 24 hours of collection.

Tissue Processing for Immunophenotyping

Tumor tissues were weighed and dissociated using a mild cocktail of collagenase I, II, IV and DNAse I, followed by Ficoll separation. Peripheral white blood cells were separated from red blood cells using sedimentation buffer (Miltenyi Biotech). Cell suspensions (from tumor tissues or peripheral blood) were washed two times in phosphate-buffered saline (PBS) without calcium and magnesium, stained with near-infrared (NIR) Viability Dye (Molecular Probes by Life Technologies, Catalog L34976). Fc receptors were blocked with human gamma globulin (Jackson Immunoresearch) or mouse IgG serum (Sigma Aldrich) in 'FACS buffer' (PBS containing 0.5% fetal bovine serum and 0.1% sodium azide), then samples were stained with various cocktails of antibodies (see Table 1, 2, 3, 4) at 4° C. in the dark for 45 minutes. The cells were then washed twice with FACS buffer and fixed with FACS Lysing solution (BD Biosciences, cat #349202). Fluorescence minus one (FMO) controls were prepared for a subset of antibodies and used to determine positive cell populations. Samples were acquired on the Fortessa flow cytometer (BD Biosciences) and data were analyzed using FlowJo Software (TreeStar).

Antibody Staining for Flow Cytometry Analysis

Figure 3A:
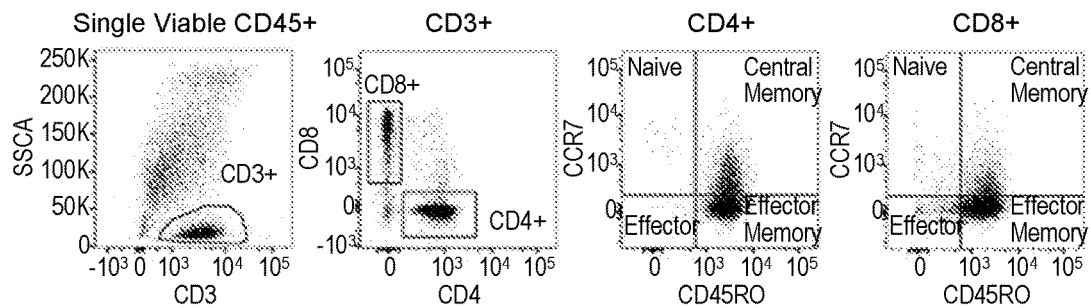
FIGS. 3A to 3C show the frequencies of different T cell subsets that express TIM3 in the TILs from different cancer patients: kidney, lung, colon, liver, ovarian, stomach, uterine, or gastro-intestinal cancer.

To assess TIM3 expression on the different T cell subsets, the processed cells from above were stained with the antibody cocktail provided in Table 4 (below). A representative example of the gating strategy is shown in FIG. 3A: CCR7+ CD45RO− ("naïve"), CCR7+ CD45RO+ ("central memory"), CCR7− CD45RO+ ("effector memory"), and CCR7– CD45RO– ("effector"). The median frequency of these subsets in the TILs are provided in Table 5 (below).

TABLE 4

Antibody panel for TIM3 expression analysis in T cell subsets

| Marker | Clone | Fluorophore | Vendor | Catalog |
|---|---|---|---|---|
| Viability | — | Near IR | Invitrogen | L34976 |
| CD45 | HI30 | BV480 | BDBiosciences | 566115 |
| CD3 | UCHT1 | BUV496 | BDBiosciences | 564809 |
| CD4 | SK3 | AF700 | Biolegend | 344622 |
| CD8 | RPA-T8 | BUV395 | BDBiosciences | 563795 |
| CD45RO | HI100 | BV421 | Biolegend | 304224 |
| CD197 | G043H7 | BV711 | Biolegend | 353228 |
| PD-1 | MIH4 | APC | BDBiosciences | 558694 |
| TIM3 | 7D3 | BB515 | BDBiosciences | 565568 |

Figure 3B:
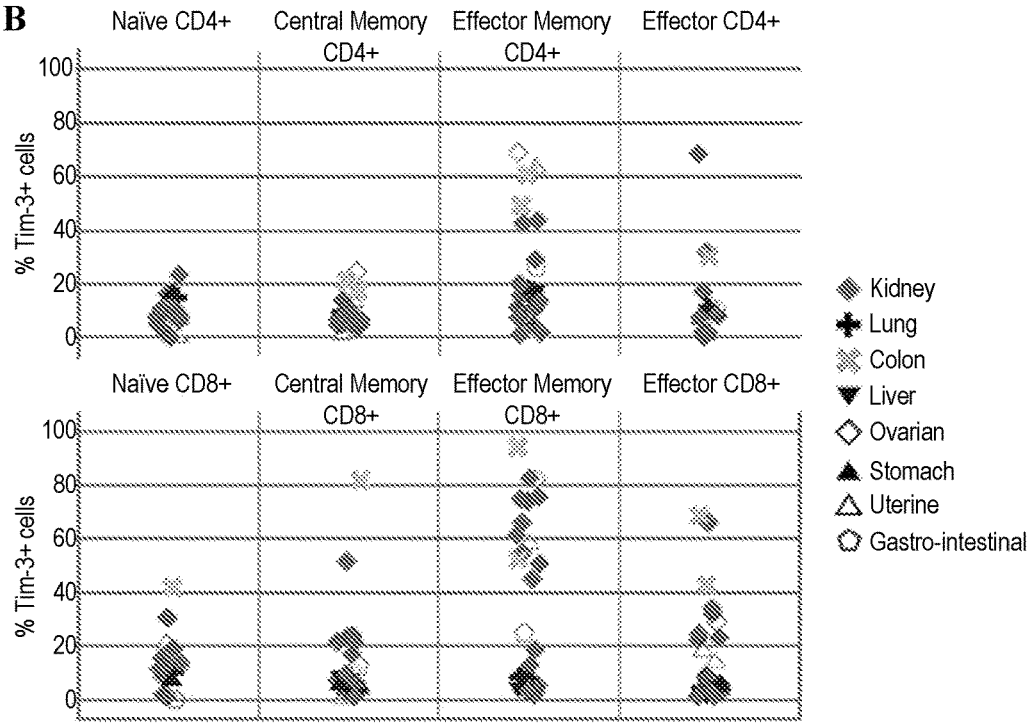

As shown in FIG. 3B, the frequency of TIM3+ cells varied depending on both the T cell subset and the individual patient, with a general trend towards greater percentage of effector memory and effector CD4+ and CD8+ T cells expressing TIM3. The fact that greater percentage of effector and effector memory T cells expressing TIM3 in some patients suggests a potential for reactivation of the T cell response with TIM3 inhibition. In addition, the data suggests that greater frequencies of TIM-3+ effector and/or TIM3+ effector memory T cells in TILs of a subject having cancer indicates that the subject would respond to a cancer therapy with a TIM-3 antagonist, such as an anti-TIM-3 antibody.

Figure 3C:
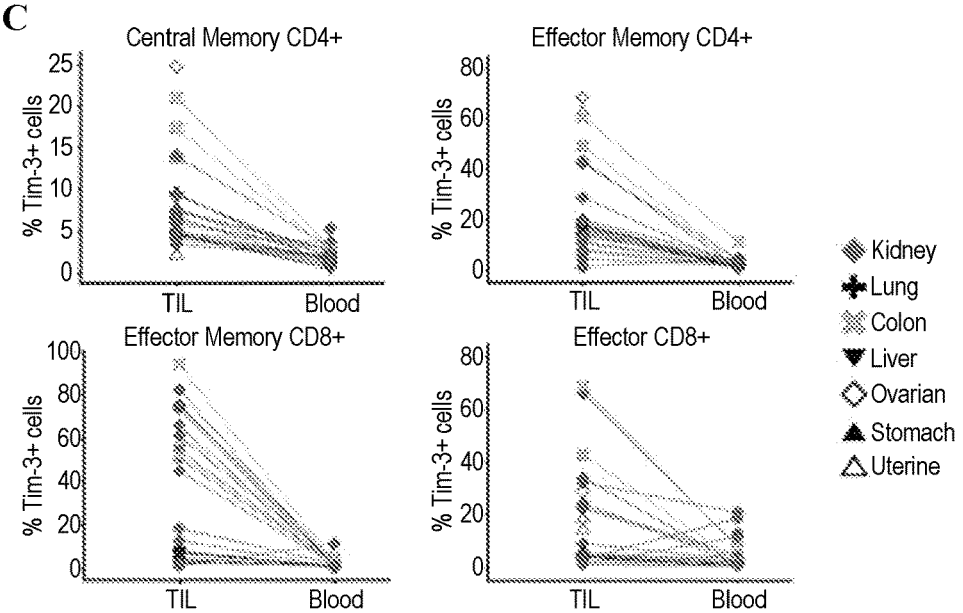

In the whole blood, because of the very low frequency of TIM3+ T cells, there did not appear to be a significant correlation between the frequency of TIM3+ T cells in TIL and in the corresponding whole blood (see FIG. 3C).

TABLE 5

Median frequencies of CD4 and CD8 T cell subsets

| Median frequencies in TIL | Naive | Central Memory | Effector Memory | Effector |
|---|---|---|---|---|
| % of CD4+ | 2.9 | 32 | 60 | 1.5 |
| % of CD8+ | 2.1 | 5.2 | 68 | 19 |

Figure 4A:
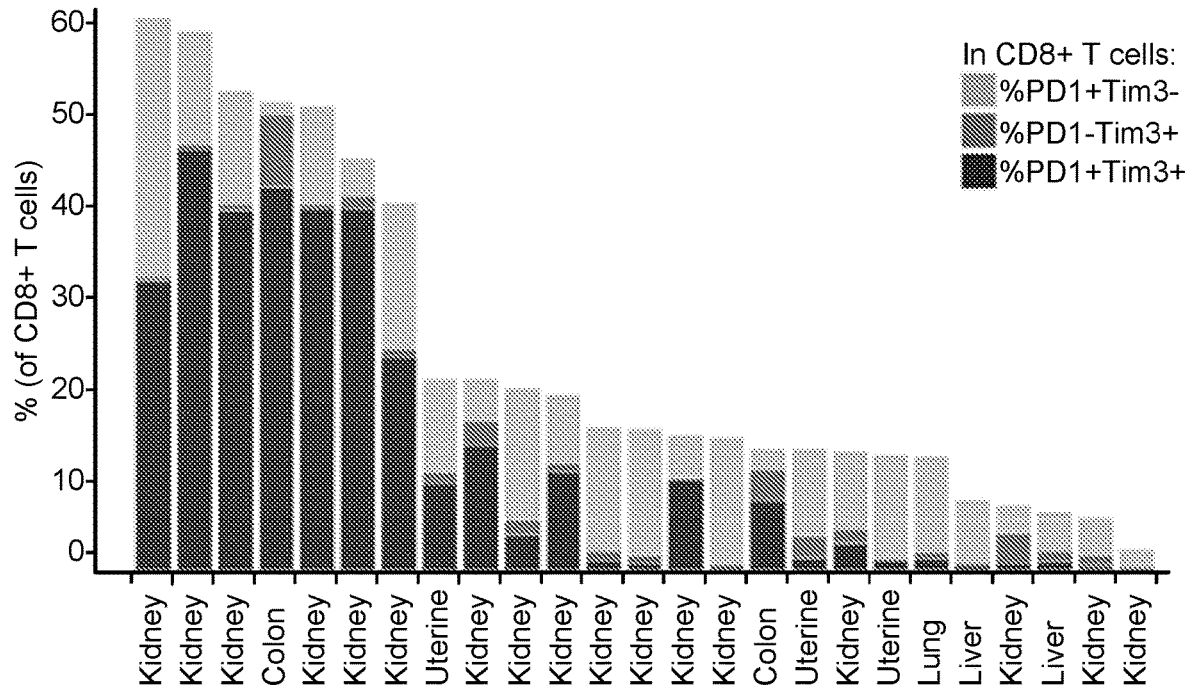
FIGS. 4A and 4B show the frequencies of CD8+ T cells that express TIM3 and/or PD-1 in the TILs from different cancer patients (i.e., kidney, colon, uterine, or lung).
Figure 4B:
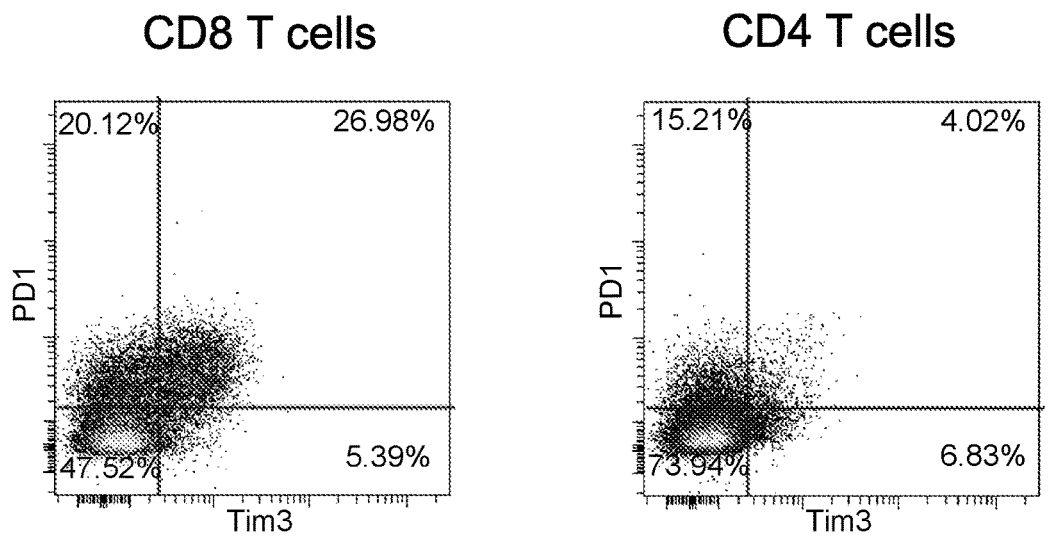

In addition to the above, PD-1 co-expression was also assessed in the TILs of the above cancer patients. As observed in Example 1, most of the TIM3+ CD8+ TILs were also PD-1 positive in most of the analyzed samples (see FIGS. 4A and 4B). Very few CD8+ TILs were TIM3+ PD-1–, and in about half of the samples, majority of the PD1+ CD8+ TILs were also positive for TIM3 expression. This result, along with that from Example 1, supports the use of the combination of a PD-1 antagonist (e.g., an anti-PD-1 antibody, e.g., nivolumab) with a TIM3 antagonist for treating cancer, e.g., in subjects that are TIM-3+PD-1+.

Example 3

Analysis of TIM3 Expression in Different Immune Cell Subsets

Because T cells are not the only immune cells to express TIM3, both myeloid and NK cells isolated from the TILs from a subset of the samples described in Example 2 were also assessed for TIM3 expression. The antibody cocktails used to identify these immune cell subsets are provided in Tables 6 and 7 (below).

TABLE 6

Antibody panel for TIM3 expression analysis in myeloid cell subsets

| Marker | Clone | Fluorophore | Vendor | Catalog |
|---|---|---|---|---|
| Viability | — | Near IR | Invitrogen | L34976 |
| CD3 | SK7 | BV605 | BD biosciences | 563219 |
| CD19 | HIB19 | BV605 | BD biosciences | 562653 |
| CD56 | 5.1H11 | BV605 | BD biosciences | 562780 |
| CD45 | 2D1 | PerCP-Cy5.5 | Biolegend | 340953 |
| HLA-DR | G46-6 | BV510 | BD biosciences | 563083 |
| CD14 | M5E2 | AF700 | BD biosciences | 557923 |
| CD15 | W6D3 | BUV395 | BD biosciences | 740318 |
| CD11c | B-ly6 | BV650 | BD biosciences | 563404 |
| CD64 | 10.1 | BV785 | BD biosciences | 740980 |
| CD303 | 201A | PE-Cy7 | Biolegend | 354214 |
| TIM3 | 7D3 | BV421 | BD biosciences | 565562 |

TABLE 7

Antibody panel for TIM3 expression analysis in NK cells

| Marker | Clone | Fluorophore | Vendor | Catalog |
|---|---|---|---|---|
| Viability | — | APC-Cy7 | Invitrogen L34976 | L34976 |
| CD45 | 2D1 | PerCP-Cy5.5 | Biolegend | 340953 |
| CD19 | SJ25C1 | BV605 | BD biosciences | 562653 |
| CD27 | L128 | BV510 | BD biosciences | 563092 |
| CD3 | SK7 | BV786 | Biolegend | 344842 |
| CD16 | 3G8 | AF700 | BD biosciences | 560713 |
| CD56 | NCAM16.2 | BV650 | BD biosciences | 564057 |
| CD57 | NK-1 | APC | BD biosciences | 560845 |
| TIM3 | 7D3 | BV421 | BD biosciences | 565562 |

Figure 5A:
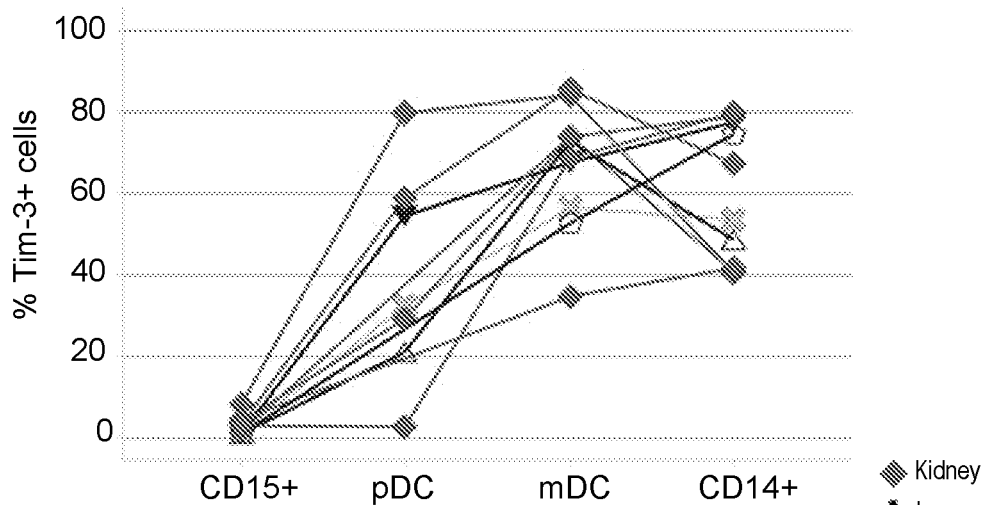
FIGS. 5A and 5B show the frequencies of different myeloid cells (FIG. 5A) and NK cells (FIG. 5B) in the TILs from different cancer patients that express TIM3.
Figure 5B:
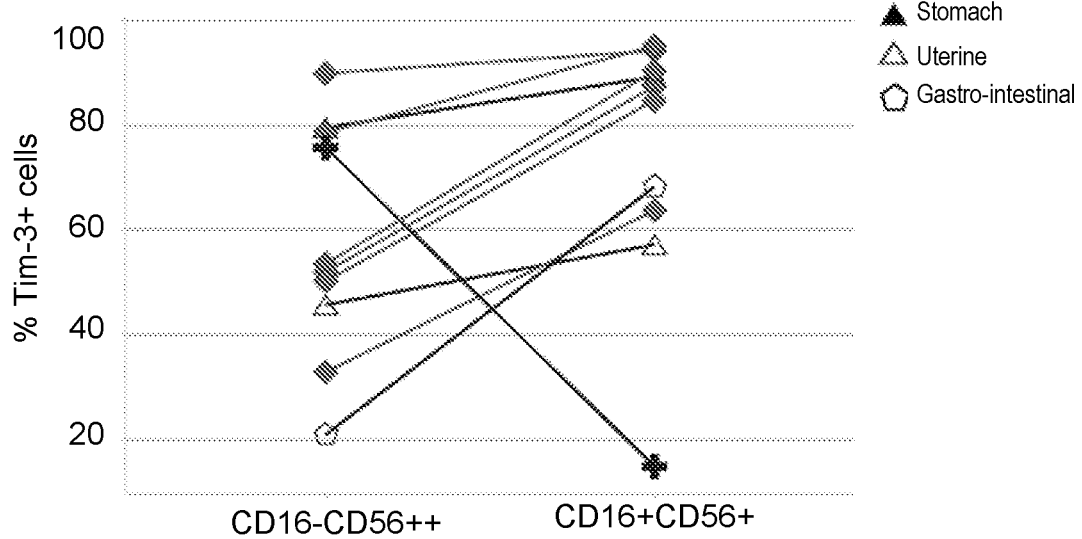

As shown in FIG. 5A, very little CD15+ granulocytes expressed TIM3. In contrast, the frequency of plasmacytoid dendritic cells (pDC), myeloid dendritic cells (mDC), and CD14+ CD64+ monocytes/macrophages expressing TIM3 varied across the patients, with frequencies reaching as high as 80% or more. The frequency of TIM3+ CD16– CD56+ and CD16+CD56+ NK cell subsets also varied across patients, ranging from 15% to 95% (FIG. 5B).

Example 4

Analysis of Soluble TIM3 Expression in the Serum

To compare soluble TIM3 expression in the serum of healthy subjects and cancer patients, frozen serum samples from 20 normal healthy volunteers, 20 colon, 20 kidney and 20 lung cancer patients were thawed on ice and tested at 1:4 dilution for soluble Tim-3 with a commercially available ELISA kit (Quantikine ELISA, cat #DTIM30, R&D Systems).

Figure 6A:
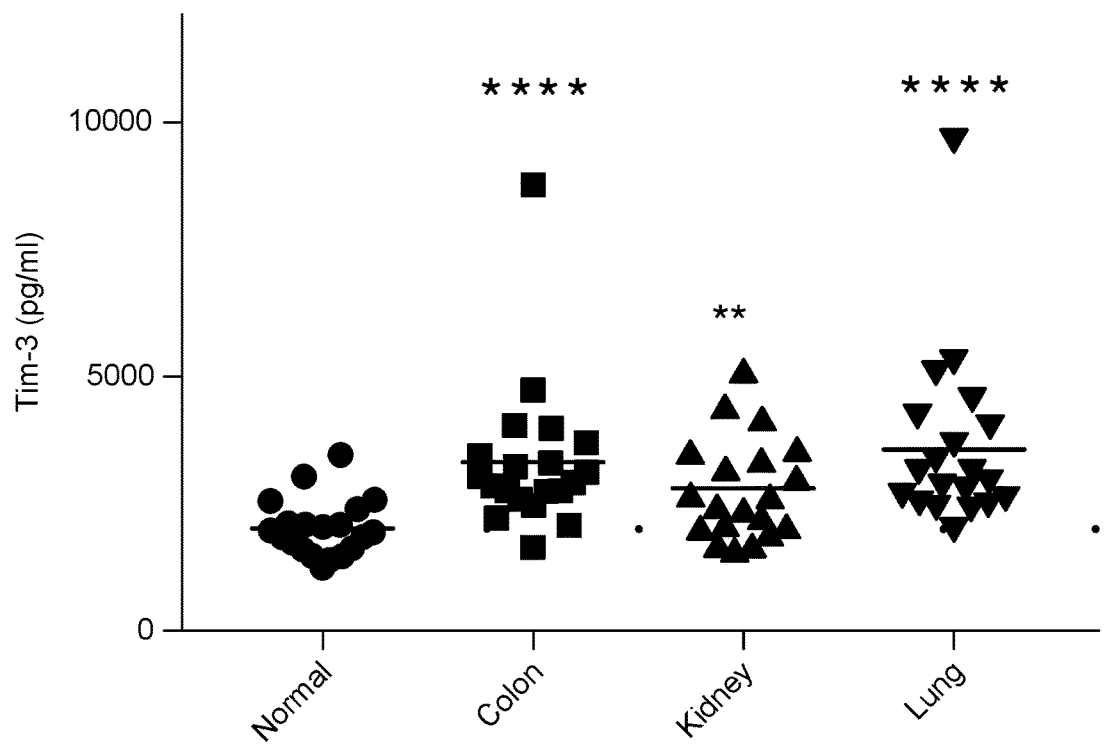
FIGS. 6A and 6B show the level of soluble TIM3 protein in the sera from healthy human subjects ("normal") and cancer patients (colon, kidney, and lung).
Figure 6B:
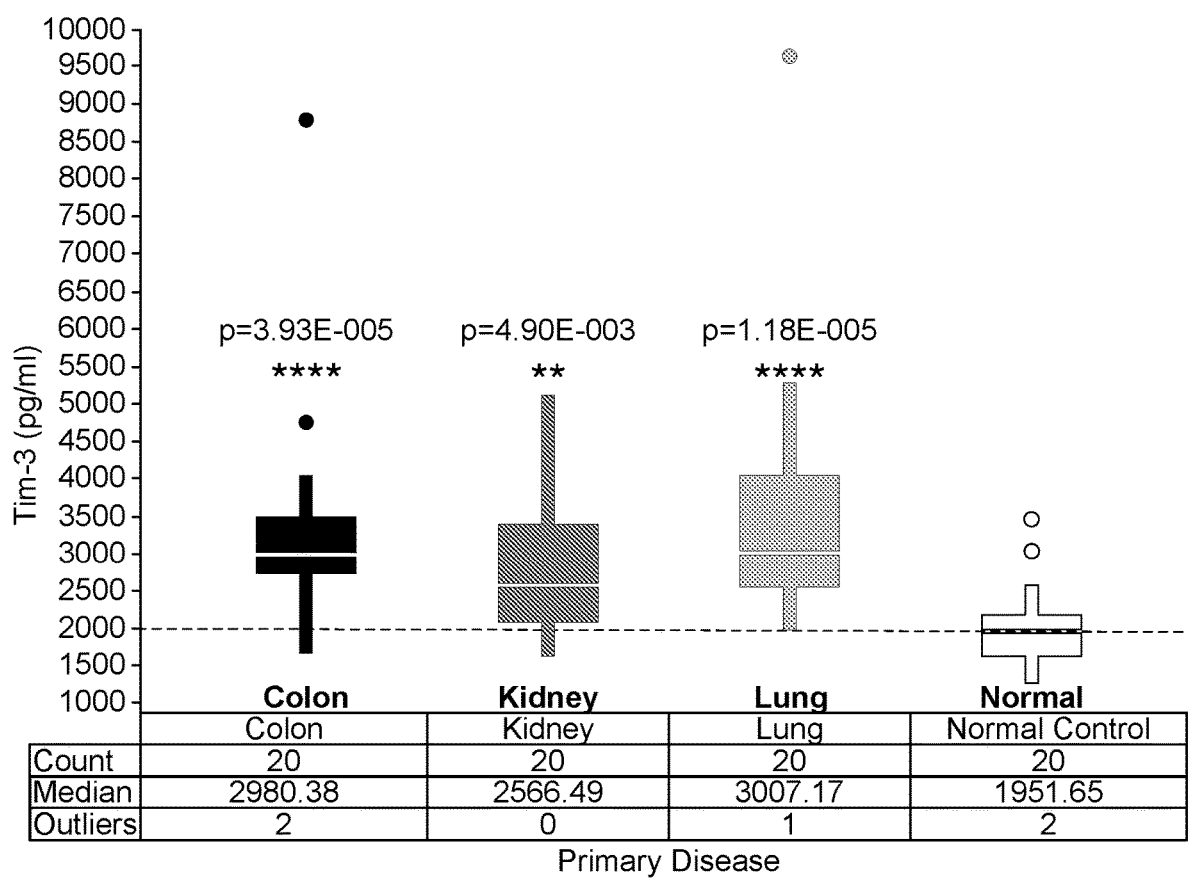

As shown in FIGS. 6A and 6B, the soluble TIM3 expression (includes both soluble isoform of TIM3 and TIM3 shed from the membrane of the cells) in the cancer patients were significantly higher than that observed in the healthy donors (colon and lung vs. normal $p<0.0001$; kidney vs. normal, $p<0.01$, Mann Whitney test). Such result indicate that soluble TIM3 levels are increased in the sera of cancer patients compared to normal controls. Thus, soluble TIM-3 can be used as a stratification marker. Additional analysis will determine the correlation between soluble TIM3 expression and the levels of TIM3 expression on the corresponding TIL subsets.

TABLE 8

| SEQ ID | Antibody | Description | Sequences |
|---|---|---|---|
| 1 | 13A3 | VH | QLQLQESGPGLVKPSETLSLTCTVSGGSISSRSTYWGWIRQPPGKGLEWIGSITYSGFTYYNPSLKSRVTISVDTSKNQFSLKLSSVTAADTAVYYCATGGPYGDYAHWFDPWGQGTLVTVSS |
| 2 | 829 | VH | QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSS |
| 3 | 8C4 | VH | QVQLQESGPGLVKPSETLSLTCTVSGGSISRYTWSWIRQPPGKGLEWIGYIHYTGSTNYNPSLKSRVTISVDTSKNQFSLKLSSVTAADTAVYYCATDTGYYGMDVWGQGTTVTVSS |
| 4 | 17C3 | VH | QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSS |
| 5 | 9F6 | VH | QVQLVESGGGLVKPGGSLRLSCAASGFTESDYYMSWIRQAPGKGLEWVSFISGGGSTITYADSVKGRFTISRDNAKNSLFLQMNSLRVEDTAVYYCARDGYSSGWYTYGMDVWGQGTAVTVSS |
| 6 | 3G4 | VH | QVQLVESGGGLVKPGGSLRLSCAASGFTESDYYMSWIRQAPGKGLEWVSFISTSGSTITYADSVKGRFTISRDNAKNSLYLQMNSLRAEDTAVYYCAREGYSSSWSYYYGMDVWGQGTTVTVSS |
| 7 | 17C8 | VH | QVQLVESGGGLVKPGGSLRLSCAASGFTESDYYMSWIRQAPGKGLEWVSFISSSGSTITYADSVKGRFTISRDNAKNSLYLQMNSLRAEDTAVYYCARDGYSSGWEYYGMDVWGQGTTVTVSS |
| 8 | 13A3 (N60Q) | VH | QLQLQESGPGLVKPSETLSLTCTVSGGSISSRSTYWGWIRQPPGKGLEWIGSITYSGFTYYQPSLKSRVTISVDTSKNQFSLKLSSVTAADTAVYYCATGGPYGDYAHWFDPWGQGTLVTVSS |
| 9 | 13A3 (N60S) | VH | QLQLQESGPGLVKPSETLSLTCTVSGGSISSRSTYWGWIRQPPGKGLEWIGSITYSGFTYYSPSLKSRVTISVDTSKNQFSLKLSSVTAADTAVYYCATGGPYGDYAHWFDPWGQGTLVTVSS |
| 10 | 13A3 (N60A) | VH | QLQLQESGPGLVKPSETLSLTCTVSGGSISSRSTYWGWIRQPPGKGLEWIGSITYSGFTYYAPSLKSRVTISVDTSKNQFSLKLSSVTAADTAVYYCATGGPYGDYAHWFDPWGQGTLVTVSS |
| 11 | 13A3 (D101E) | VH | QLQLQESGPGLVKPSETLSLTCTVSGGSISSRSTYWGWIRQPPGKGLEWIGSITYSGFTYYNPSLKSRVTISVDTSKNQFSLKLSSVTAADTAVYYCATGGPYGDYAHWFEPWGQGTLVTVSS |
| 12 | 13A3 (P102V) | VH | QLQLQESGPGLVKPSETLSLTCTVSGGSISSRSTYWGWIRQPPGKGLEWIGSITYSGFTYYNPSLKSRVTISVDTSKNQFSLKLSSVTAADTAVYYCATGGPYGDYAHWFDVWGQGTLVTVSS |
| 13 | 13A3 (P102Y) | VH | QLQLQESGPGLVKPSETLSLTCTVSGGSISSRSTYWGWIRQPPGKGLEWIGSITYSGFTYYNPSLKSRVTISVDTSKNQFSLKLSSVTAADTAVYYCATGGPYGDYAHWFDYWGQGTLVTVSS |
| 14 | 13A3 (P102L) | VH | QLQLQESGPGLVKPSETLSLTCTVSGGSISSRSTYWGWIRQPPGKGLEWIGSITYSGFTYYNPSLKSRVTISVDTSKNQFSLKLSSVTAADTAVYYCATGGPYGDYAHWFDLWGQGTLVTVSS |
| 15 | 13A3 (N60Q, P102Y) | VH | QLQLQESGPGLVKPSETLSLTCTVSGGSISSRSTYWGWIRQPPGKGLEWIGSITYSGFTYYQPSLKSRVTISVDTSKNQFSLKLSSVTAADTAVYYCATGGPYGDYAHWFDYWGQGTLVTVSS |
| 16 | 8B9 (S61P) | VH | QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSS |
| 17 | 9F6 (A108T) | VH | QVQLVESGGGLVKPGGSLRLSCAASGFTESDYYMSWIRQAPGKGLEWVSFISGGGSTITYADSVKGRFTISRDNAKNSLFLQMNSLRVEDTAVYYCARDGYSSGWYTYGMDVWGQGTTVTVSS |
| 18 | 13A3 (N60Q, D101E) | VH | QLQLQESGPGLVKPSETLSLTCTVSGGSISSRSTYWGWIRQPPGKGLEWIGSITYSGFTYYQPSLKSRVTISVDTSKNQFSLKLSSVTAADTAVYYCATGGPYGDYAHWFEPWGQGTLVTVSS |
| 19 | 13A3, 17C3, 3G4 | VL | EIVLTQSPGTLSLSPGERATLSCRASQSVSSSYLAWYQQKPGQAPRLLITGASSRATGIPDRFSGSGSGTDFTLTISRLEPEDFAVYYCQQYGSSPITFGQGTRLEIK |

TABLE 8-continued

| SEQ ID | Antibody | Description | Sequences |
|---|---|---|---|
| 20 | 8B9, 8C4, 17C8, 9F6 (VK3) | VL | EIVLTQSPGTLSLSPGERATLSCRASQSVSSSYLAWYQQKPGQAPRLLIT GASSRATGIPDRFSGSGSGTDFTLTISRLEPEDFAVYYCQQYGSSPLTEG GGTKVEIK |
| 21 | 9F6 (VK1) | VL | ATQLTQSPSSLSASVGDRVTITCRASQGISSALAWYQQKPGKAPKLLITD ASSLESGVPSRFSGSGSGTDFTLTISSLQPEDFATTYCQQFNSTPRTFGQ GTKVEIK |
| 22 | 9F6 (VK2) | VL | EIVLTQSPGTLSLSPGERATLSCRASQSVSSSYLAWYQQKPGQAPRLLIY GASSRATGIPDRFSGSGSGTDFTLTISRLEPEDFAVYYCQQYGSSLTFGG GTKVEIK |
| 23 | 13A3, including the following 13A3 variants: N60Q; N60S; N60A; D101E; P102V; P102Y; P102L; N60Q and P102Y; N60Q and D101E | CDR1 (VH) | SRSYYWG |
| 24 | 8B9, including the 8B9 (S61P) variant | CDR1 (VH) | RHYWN |
| 25 | 8C4 | CDR1 (VH) | RYYWS |
| 26 | 17C3 | CDR1 (VH) | SYYMH |
| 27 | 9F6, including the 9F6 (A108T) variant; 3G4; 17C8 | CDR1 (VH) | DYYMS |
| 28 | 13A3, including the following 13A3 variants: D101E, P102V, P102Y, and P102L | CDR2 (VH) | SIYYSGFTYYNPSLIKS |
| 29 | 8B9 | CDR2 (VH) | YIHYSGSTNYNSSLKS |
| 30 | 8C4 | CDR2 (VH) | YIHYTGSTNYNPSLKS |
| 31 | 17C3 | CDR2 (VH) | IINPRGDSIIYAQHFQG |
| 32 | 9F6, including the 9F6 (A108T) variant | CDR2 (VH) | FISGGGSTIYYADSVKG |
| 33 | 3G4 | CDR2 (VH) | FISTSGSITYYADSVKG |
| 34 | 17C8 | CDR2 (VH) | FISSSGSITYYADSVKG |
| 35 | 13A3 (N60Q); | CDR2 (VH) | SIYYSGFTYYQPSLKS |

TABLE 8-continued

| SEQ ID | Antibody | Description | Sequences |
|---|---|---|---|
| | 13A3 (N60Q, P102Y); 13A3 (N60Q, D101E) | | |
| 36 | 13A3 (N60S) | CDR2 (VH) | SIYYSGFTYYSPSLIKS |
| 37 | 13A3 (N60A) | CDR2 (VH) | SIYYSGFTYYAPSLIKS |
| 38 | 8B9 (S61P) | CDR2 (VH) | YIHYSGSTNYNPSLKS |
| 39 | 13A3, including the following 13A3 variants: N60Q, N60S, N60A | CDR3 (VH) | GGPYGDYAHWFDP |
| 40 | 8B9, including the 8B9 (S61P) variant | CDR3 (VH) | DTGYYGMDI |
| 41 | 8C4 | CDR3 (VH) | DTGYYGMDV |
| 42 | 17C3 | CDR3 (VH) | DFYGSGNYYYGMDV |
| 43 | 9F6, including the 9F6 (A108T) variant | CDR3 (VH) | DGYSSGWYYYGMDV |
| 44 | 3G4 | CDR3 (VH) | EGYSSSWSYYYGMDV |
| 45 | 17C8 | CDR3 (VH) | DGYSSGWEYYGMDV |
| 46 | 13A3 (D101E); 13A3 (N60Q, D101E) | CDR3 (VH) | GGPYGDYAHWFEP |
| 47 | 13A3 (P102V) | CDR3 (VH) | GGPYGDYAHWFDV |
| 48 | 13A3 (P102Y); 13A3 (N60Q, P102Y) | CDR3 (VH) | GGPYGDYAHWFDY |
| 49 | 13A3 (P102L) | CDR3 (VH) | GGPYGDYAHWFDL |
| 50 | 13A3, 8B9, 8C4, 17C3, 9F6 (VK2, VK3), 3G4, 17C8 | CDR1 (VL) | RASQSVSSSYLA |

TABLE 8-continued

| SEQ ID | Antibody | Description | Sequences |
|---|---|---|---|
| 51 | 9F6 (VK1) | CDR1 (VL) | RASQGISSALA |
| 52 | 13A3, 8B9, 8C4, 17C3, 9F6 (VK2, VK3), 3G4, 17C8 | CDR2 (VL) | GASSRAT |
| 53 | 9F6 (VK1) | CDR2 (VL) | DASSLES |
| 54 | 13A3, 17C3, 3G4 | CDR3 (VL) | QQYGSSPIT |
| 55 | 8B9, 8C4, 9F6 (VK3), 17C8 | CDR3 (VL) | QQYGSSPLT |
| 56 | 9F6 (VK1) | CDR3 (VL) | QQFNSYPRT |
| 57 | 9F6 (VK2) | CDR3 (VL) | QQYGSSLT |
| 58 | | WT human IgG1 constant domain (same as IgG1za) | ASTKGPSVFPLAPSSKSTSGGTAALGCLVHDYFPEPVTVSWNSGALTSGV HTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWLNGK EYKCKVSNKALPAPIEKTISKAKGQPREPQVYTLPPSRDELTKNQVSLTC LVKGFYPSDIAVEWESNGQPENNYKTTPPVLDSDGSFFLYSKLTVDKSRW QQGNVFSCSVMHEALHNHYTQKSLSLSPGK |
| 59 | | human IgG1 (allotypic variant) | ASTKGPSVFPLAPSSKSTSGGTAALGCLVHDYFPEPVTVSWNSGALTSGV HTFPAVLQSSGLYSLSSVVTVPSSSLGTQTYICNVNHKPSNTKVDKRVEP KSCDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWLNGK EYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRW QQGNVFSCSVMHEALHNHYTQKSLSLSPGK |
| 60 | | IgG1.1 constant domain (used in anti-TIM3 antibodies) | ASTEGPSVFPLAPSSESTSGGTAALGCLVEDYFPEPVTVSWNSGALTSGV HTFPAVLQSSGLYSLSSVVTVPSSSLGTQTYICNVNHEPSNTEVDERVEP ESCDKTHTCPPCPAPEAEGAPSVFLEPPEPEDTLMISRTPEVTCVVVDVS HEDPEVEFNWYVDGVEVHNAKTKPREEQYNSTYRVVSVLTVLHQDWLNGE EYECKVSNKALPSSIEKTISKAKGQPREPQVYTLPPSREEMTENQVSLTC LVEGFYPSDIAVEWESNGQPENNYKTTPPVLDSDGSFFLYSKLTVDKSRW QQGNVESCSVMHEALHNHYTQESLSLSPGK |
| 61 | | IgG1.3 constant domain (used in anti-TIM3 antibodies) | ASTEGPSVFPLAPSSESTSGGTAALGCLVEDYFPEPVTVSWNSGALTSGV HTFPAVLQSSGLYSLSSVVTVPSSSLGTQTYICNVNHEPSNTEVDERVEP ESCDKTHTCPPCPAPEAEGAPSVFLEPPEPEDTLMISRTPEVTCVVVDVS HEDPEVEFNWYVDGVEVHNAKTKPREEQYNSTYRVVSVLTVLHQDWLNGE EYECKVSNKALPAPIEKTISKAKGQPREPQVYTLPPSREEMTENQVSLTC LVEGFYPSDIAVEWESNGQPENNYKTTPPVLDSDGSFFLYSKLTVDKSRW QQGNVESCSVMHEALHNHYTQESLSLSPGK |
| 63 | | human IgG4 constant domain | RTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTK SFNRGEC |
| 64 | | human IgG1 kappa light chain | LSPGK |
| 65 | | LSPGK (C-terminal end of heavy chain) | LSPG |
| 66 | | LSPG (C-terminal end of heavy chain) | LSP |

TABLE 8-continued

| SEQ ID | Antibody | Description | Sequences |
|---|---|---|---|
| 67 | | LSP (C-terminal end of heavy chain) | RTVAAPSVFIFPPSDEQLKSGTASVVCLLNNFYPREAKVQWKVDNALQSG NSQESVTEQDSEDSTYSLSSTLTLSKADYEKHKVYACEVTHQGLSSPVTK SFNRGEC |
| 68 | 13A3 | IgG1.1f HC | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYECKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGK* |
| 69 | 8B9 | IgG1.1f HC | QVQLQESGPGLVKPSETLSLTCTVSGGSISRHYWNWIRQPPGEGLEWIGY IHYSGSTNYNSSLESRVTISVDTSKNQFSLELSSVTAADTAVYYCARDTG YYGMDIWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLEPPEPEDT LMISRTPEVTCVVVDVSHEDPEVEFNWYVDGVEVHNAKTKPREEQYNSTY RVVSVLTVLHQDWLNGKEYECKVSNKALPSSIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPGK* |
| 70 | 8C4 | IgG1.1f HC | QVQLQESGPGLVKPSETLSLTCTVSGGSISRYYWSWIRQPPGEGLEWIGY IHYTGSTNYNPSLESRVTISVDTSKNQFSLELSSVTAADTAVYYCATDTG YYGMDVWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLEPPEPEDT LMISRTPEVTCVVVDVSHEDPEVEFNWYVDGVEVHNAKTKPREEQYNSTY RVVSVLTVLHQDWLNGKEYECKVSNKALPSSIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPGK* |
| 71 | 17C3 | IgG1.1f HC | QVQLVQSGAEVKKPGASVKVSCKASGYTFTSYYMHWVRQAPGQGLEWMGI INPRGDSIIYAQHFQGRVTMTRDTSTSTVYMELSSLRSEDTAVYYCARDF YGSGNYTYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYECKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGK* |
| 72 | 9F6 | IgG1.1f HC | QVQLVESGGGLVKPGGSLRLSCAASGFTFSDYYMSWIRQAPGEGLEWVSF ISGGGSTITYADSVEGRFTISRDNAHNSLFLQMNSLRVEDTAVYYCARDG YSSGWYTYGMDVWGQGTAVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYECKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGIK* |
| 73 | 3G4 | IgG1.1f HC | QVQLVESGGGLVKPGGSLRLSCAASGFTFSDYYMSWIRQAPGEGLEWVSF ISTSGSIITYADSVEGRFTISRDNAHNSLYLQMNSLRAEDTAVYYCAREG YSSSWSYYYGMDVWGQGTTVTVSSASTEGPSVFPLAPSSESTSGGTAALG CLVEDYFPEPVTVSWNSGALTSGVHTFPAVLQSSGLYSLSSVVTVPSSSL GTQTYICNVNHEPSNTEVDERVEPESCDKTHTCPPCPAPEAEGAPSVFLF PPEPEDTLMISRTPEVTCVVVDVSHEDPEVKFNWYVDGVEVHNAKTKPRE EQYNSTYRVVSVLTVLHQDWLNGKEYECKVSNKALPSSIEKTISKAKGQP REPQVYTLPPSREEMTENQVSLTCLVKGFYPSDIAVEWESNGQPENNYET TPPVLDSDGSFFLYSKLTVDKSRWQQGNVFSCSVMHEALHNHYTQESLSL SPGK* |
| 74 | 17C8 | IgG1.1f HC | QVQLVESGGGLVKPGGSLRLSCAASGFTFSDYYMSWIRQAPGEGLEWVSF ISSSGSIITYADSVEGRFTISRDNAHNSLYLQMNSLRAEDTAVYYCAREG YSSGWEYYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYECKVSNKALPSSIEKTISKAKGQPR |

TABLE 8-continued

| SEQ ID | Antibody | Description | Sequences |
|---|---|---|---|
| | | | EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGK* |
| 75 | 13A3 | IgG1.1f HC (no C-terminal K) | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 76 | 8B9 | IgG1.1f HC (no C-terminal K) | QVQLQESGPGLVKPSETLSLTCTVSGGSISRHYWNWIRQPPGEGLEWIGY IHYSGSTNYNSSLESRVTISVDTSKNQFSLELSSVTAADTAVYYCARDTG YYGMDIWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLFPPPEPDT LMISRTPEVTCVVVDVSHEDPEVKFNWYVDGVEVHNAKTKPREEQYNSTY RVVSVLTVLHQDWLNGKEYKCKVSNKALPSSIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPG* |
| 77 | 8C4 | IgG1.1f HC (no C-terminal K) | QVQLQESGPGLVKPSETLSLTCTVSGGSISRYYWSWIRQPPGEGLEWIGY IHYTGSTNYNPSLESRVTISVDTSKNQFSLELSSVTAADTAVYYCATDTG YYGMDVWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLFPPPEPDT LMISRTPEVTCVVVDVSHEDPEVKFNWYVDGVEVHNAKTKPREEQYNSTY RVVSVLTVLHQDWLNGKEYKCKVSNKALPSSIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPG* |
| 78 | 17C3 | IgG1.1f HC (no C-terminal K) | QVQLVQSGAEVKKPGASVKVSCKASGYTFTSYYMHWVRQAPGQGLEWMGI INPRGDSIIYAQHFQGRVTMTRDTSTSTVYMELSSLRSEDTAVYYCARDF YGSGNYTYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 79 | 9F6 | IgG1.1f HC (no C-terminal K) | QVQLVESGGGLVEPGGSLRLSCAASGFTFSDYYMSWIRQAPGEGLEWVSF ISGGGSTITYADSVEGRFTISRDNAHNSLFLQMNSLRVEDTAVYYCARDG YSSGWYTYGMDVWGQGTAVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 80 | 3G4 | IgG1.1f HC (no C-terminal K) | QVQLVESGGGLVEPGGSLRLSCAASGFTFSDYYMSWIRQAPGEGLEWVSF ISTSGSIITYADSVEGRFTISRDNAHNSLYLQMNSLRAEDTAVYYCAREG YSSSWSYYYGMDVWGQGTTVTVSSASTEGPSVFPLAPSSESTSGGTAALG CLVEDYFPEPVTVSWNSGALTSGVHTFPAVLQSSGLYSLSSVVTVPSSSL GTQTYICNVNHEPSNTEVDERVEPESCDKTHTCPPCPAPEAEGAPSVFLF PPEPEDTLMISRTPEVTCVVVDVSHEDPEVKFNWYVDGVEVHNAKTKPRE EQYNSTYRVVSVLTVLHQDWLNGKEYKCKVSNKALPSSIEKTISKAKGQP REPQVYTLPPSREEMTENQVSLTCLVKGFYPSDIAVEWESNGQPENNYET TPPVLDSDGSFFLYSKLTVDKSRWQQGNVFSCSVMHEALHNHYTQESLSL SPG* |
| 81 | 17C8 | IgG1.1f HC (no C-terminal K) | QVQLVESGGGLVEPGGSLRLSCAASGFTFSDYYMSWIRQAPGEGLEWVSF ISSSGSIITYADSVEGRFTISRDNAHNSLYLQMNSLRAEDTAVYYCARDG YSSGWEYYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR |

TABLE 8-continued

| SEQ ID | Antibody | Description | Sequences |
|---|---|---|---|
| | | | EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 82 | 13A3 | IgG1.3f HC | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGK* |
| 83 | 8B9 | IgG1.3f HC | QVQLQESGPGLVKPSETLSLTCTVSGGSISRHYWNWIRQPPGEGLEWIGY IHYSGSTNYNSSLESRVTISVDTSKNQFSLELSSVTAADTAVYYCARDTG YYGMDIWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLFPPEPEDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPGK* |
| 84 | 8C4 | IgG1.3f HC | QVQLQESGPGLVKPSETLSLTCTVSGGSISRYYWSWIRQPPGEGLEWIGY IHYTGSTNYNPSLESRVTISVDTSKNQFSLELSSVTAADTAVYYCATDTG YYGMDVWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLFPPEPEDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPGK* |
| 85 | 17C3 | IgG1.3f HC | QVQLVQSGAEVKKPGASVKVSCKASGYTFTSYYMHWVRQAPGQGLEWMGI INPRGDSIIYAQHFQGRVTMTRDTSTSTVYMELSSLRSEDTAVYYCARDF YGSGNYTYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGK* |
| 86 | 9F6 | IgG1.3f HC | QVQLVESGGGLVKPGGSLRLSCAASGFTFSDYYMSWIRQAPGEGLEWVSF ISGGGSTITYADSVEGRFTISRDNAHNSLFLQMNSLRVEDTAVYYCARDG YSSGWYTYGMDVWGQGTAVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGK* |
| 87 | 3G4 | IgG1.3f HC | QVQLVESGGGLVKPGGSLRLSCAASGFTFSDYYMSWIRQAPGEGLEWVSF ISTSGSIITYADSVEGRFTISRDNAHNSLYLQMNSLRAEDTAVYYCAREG YSSSWSYYYGMDVWGQGTTVTVSSASTEGPSVFPLAPSSESTSGGTAALG CLVEDYFPEPVTVSWNSGALTSGVHTFPAVLQSSGLYSLSSVVTVPSSSL GTQTYICNVNHEPSNTEVDERVEPESCDKTHTCPPCPAPEAEGAPSVFLF PPEPEDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQP REPQVYTLPPSREEMTENQVSLTCLVKGFYPSDIAVEWESNGQPENNYET TPPVLDSDGSFFLYSKLTVDKSRWQQGNVFSCSVMHEALHNHYTQESLSL SPGK* |
| 88 | 17C8 | IgG1.3f HC | QVQLVESGGGLVKPGGSLRLSCAASGFTFSDYYMSWIRQAPGEGLEWVSF ISSSGSIITYADSVEGRFTISRDNAHNSLYLQMNSLRAEDTAVYYCARDG YSSGWEYYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR |

TABLE 8-continued

| SEQ ID | Antibody | Description | Sequences |
|---|---|---|---|
| | | | EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGIK* |
| 89 | 13A3 | IgG1.3f HC (no C-terminal K) | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 90 | 8B9 | IgG1.3f HC (no C-terminal K) | QVQLQESGPGLVKPSETLSLTCTVSGGSISRHYWNWIRQPPGEGLEWIGY IHYSGSTNYNSSLESRVTISVDTSKNQFSLELSSVTAADTAVYYCARDTG YYGMDIWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLFPPPEPDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPG* |
| 91 | 8C4 | IgG1.3f HC (no C-terminal K) | QVQLQESGPGLVKPSETLSLTCTVSGGSISRYYWSWIRQPPGEGLEWIGY IHYTGSTNYNPSLESRVTISVDTSKNQFSLELSSVTAADTAVYYCATDTG YYGMDVWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLFPPPEPDT LMISRTPEVTCVVVDVSHEDPEVKFNWYVDGVEVHNAKTKPREEQYNSTY RVVSVLTVLHQDWLNGKEYKCKVSNIALPAPIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPG* |
| 92 | 17C3 | IgG1.3f HC (no C-terminal K) | QVQLVQSGAEVKKPGASVKVSCKASGYTFTSYYMHWVRQAPGQGLEWMGI INPRGDSIIYAQHFQGRVTMTRDTSTSTVYMELSSLRSEDTAVYYCARDF YGSGNYTYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 93 | 9F6 | IgG1.3f HC (no C-terminal K) | QVQLVESGGGLVEPGGSLRLSCAASGFTFSDYYMSWIRQAPGEGLEWVSF ISGGGSTITYADSVEGRFTISRDNAHNSLFLQMNSLRVEDTAVYYCARDG YSSGWYTYGMDVWGQGTAVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PG* |
| 94 | 3G4 | IgG1.3f HC (no C-terminal K) | QVQLVESGGGLVEPGGSLRLSCAASGETESDYYMSWIRQAPGEGLEWVSF ISTSGSIIYYADSVEGRETISRDNAHNSLYLQMNSLRAEDTAVYYCAREG YSSSWSYYYGMDVWGQGTTVTVSSASTEGPSVFPLAPSSESTSGGTAALG CLVEDYFPEPVTVSWNSGALTSGVHTFPAVLQSSGLYSLSSVVTVPSSSL GTQTYICNVNHEPSNTEVDERVEPESCDKTHTCPPCPAPEAEGAPSVFLF PPEPEDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQP REPQVYTLPPSREEMTENQVSLTCLVKGFYPSDIAVEWESNGQPENNYET TPPVLDSDGSFFLYSKLTVDKSRWQQGNVESCSVMHEALHNHYTQESLSL SPG* |
| 95 | 17C8 | IgG1.3f HC (no C-terminal K) | QVQLVESGGGLVEPGGSLRLSCAASGETESDYYMSWIRQAPGEGLEWVSF ISSSGSIIYYADSVEGRETISRDNAHNSLYLQMNSLRAEDTAVYYCARDG YSSGWEYYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR |

TABLE 8-continued

| SEQ ID | Antibody | Description | Sequences |
|---|---|---|---|
| | | | EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PG* |
| 96 | 13A3 (N60Q) | IgG1.1f HC | QLQLQESGPGLVKPSETLSLTCTVSGGSISSRSYYWGWIRQPPGEGLEWI GSIYYSGFTYYQPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PGK* |
| 97 | 13A3 | IgG1.1f | QLQLQESGPGLVKPSETLSLTCTVSGGSISSRSYYWGWIRQPPGEGLEWI GSIYYSGFTYYSPSLESRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG EPEDTLMISRTPEVTCVVVDVSHEDPEVIKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PGK* |
| 98 | 13A3 (N60A) | IgG1.1f HC | QLQLQESGPGLVKPSETLSLTCTVSGGSISSRSYYWGWIRQPPGEGLEWI GSIYYSGFTYYAPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PGK* |
| 99 | 13A3 (D101E) | IgG1.1f HC | QLQLQESGPGLVKPSETLSLTCTVSGGSISSRSYYWGWIRQPPGEGLEWI GSIYYSGFTYYNPSLESRVTISVDTSKNQFSLELSSVTAADTAVYYCATG GPYGDYAHWFEPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PGK* |
| 100 | 13A3 (P102V) | IgG1.1f HC | QLQLQESGPGLVKPSETLSLTCTVSGGSISSRSYYWGWIRQPPGEGLEWI GSIYYSGFTYYNPSLESRVTISVDTSKNQFSLELSSVTAADTAVYYCATG GPYGDYAHWEDVWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGK* |
| 101 | 13A3 (P102Y) | IgG1.1f HC | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDYWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PGK* |
| 102 | 13A3 (P102L) | IgG1.1f HC | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDLWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPSREEMTENQVSLTCLVKGFYPSDIAVEWESNGQPENNYKTT |

TABLE 8-continued

| SEQ ID | Antibody | Description | Sequences |
|---|---|---|---|
| | | | PPVLDSDGSFFLYSKLTVDKSRWQQGNVFSCSVMHEALHNHYTQESLSLSPGK* |
| 103 | 13A3 (N60Q, P102Y) | IgG1.1f HC | QLQLQESGPGLVKPSETLSLTCTVSGGSISSRSYYWGWIRQPPGEGLEWIGSIYYSGFTYYQPSLKSRVTISVDTSKNQFSLELSSVTAADTAVYYCATGGPYGDYAHWFDYWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTENQVSLTCLVKGFYPSDIAVEWESNGQPENNYKTTPPVLDSDGSFFLYSKLTVDKSRWQQGNVFSCSVMHEALHNHYTQESLSLSPGK* |
| 104 | 8B9 (S61P) | IgG1.1f HC | QVQLQESGPGLVKPSETLSLTCTVSGGSISRHYWNWIRQPPGEGLEWIGYIHYSGSTNYNPSLESRVTISVDTSKNQFSLELSSVTAADTAVYYCARDTGYYGMDIWGQGTTVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTENQVSLTCLVKGFYPSDIAVEWESNGQPENNYKTTPPVLDSDGSFFLYSKLTVDKSRWQQGNVFSCSVMHEALHNHYTQESLSLSPGK* |
| 105 | 9F6 (A108T) | IgG1.1f HC | QVQLVESGGGLVEPGGSLRLSCAASGFTFSDYYMSWIRQAPGEGLEWVSFISGGGSTITYADSVEGRFTISRDNAHNSLFLQMNSLRVEDTAVYYCARDGYSSGWYTYGMDVWGQGTTVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTENQVSLTCLVKGFYPSDIAVEWESNGQPENNYKTTPPVLDSDGSFFLYSKLTVDKSRWQQGNVFSCSVMHEALHNHYTQESLSLSPGK* |
| 106 | 13A3 (N60Q) | IgG1.1f HC (no C-terminal K) | QLQLQESGPGLVKPSETLSLTCTVSGGSISSRSYYWGWIRQPPGEGLEWIGSIYYSGFTYYQPSLKSRVTISVDTSKNQFSLELSSVTAADTAVYYCATGGPYGDYAHWFDPWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTENQVSLTCLVKGFYPSDIAVEWESNGQPENNYKTTPPVLDSDGSFFLYSKLTVDKSRWQQGNVFSCSVMHEALHNHYTQESLSLSPG* |
| 107 | 13A3 (N60S) | IgG1.1f HC (no C-terminal K) | QLQLQESGPGLVKPSETLSLTCTVSGGSISSRSYYWGWIRQPPGEGLEWIGSIYYSGFTYYSPSLKSRVTISVDTSKNQFSLELSSVTAADTAVYYCATGGPYGDYAHWFDPWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTENQVSLTCLVKGFYPSDIAVEWESNGQPENNYKTTPPVLDSDGSFFLYSKLTVDKSRWQQGNVFSCSVMHEALHNHYTQESLSLSPG* |
| 108 | 13A3 (N60A) | IgG1.1f HC (no C-terminal K) | QLQLQESGPGLVKPSETLSLTCTVSGGSISSRSYYWGWIRQPPGEGLEWIGSIYYSGFTYYAPSLKSRVTISVDTSKNQFSLELSSVTAADTAVYYCATGGPYGDYAHWFDPWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTENQVSLTCLVKGFYPSDIAVEWESNGQPENNYKTTPPVLDSDGSFFLYSKLTVDKSRWQQGNVESCSVMHEALHNHYTQESLSLSPG* |
| 109 | 13A3 (D101E) | IgG1.1f HC (no C-terminal K) | QLQLQESGPGLVKPSETLSLTCTVSGGSISSRSYYWGWIRQPPGEGLEWIGSIYYSGFTYYNPSLKSRVTISVDTSKNQFSLELSSVTAADTAVYYCATGGPYGDYAHWEEPWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPR |

TABLE 8-continued

| SEQ ID | Antibody | Description | Sequences |
|---|---|---|---|
| | | | EPQVYTLPPSREEMTENQVSLTCLVKGFYPSDIAVEWESNGQPENNYKTT<br>PPVLDSDGSFFLYSKLTVDKSRWQQGNVESCSVMHEALHNHYTQESLSLS<br>PG* |
| 110 | 13A3<br>(P102V) | IgG1.1f HC<br>(no C-<br>terminal<br>K) | QLQLQESGPGLVKPSETLSLTCTVSGGSISSRSYYWGWIRQPPGEGLEWI<br>GSIYYSGFTYYNPSLKSRVTISVDTSKNQFSLELSSVTAADTAVYYCATG<br>GPYGDYAHWEDVWGQGTLVTVSSASTEGPSVFPLAPSSESTSGGTAALGC<br>LVEDYFPEPVTVSWNSGALTSGVHTFPAVLQSSGLYSLSSVVTVPSSSLG<br>TQTYICNVNHEPSNTEVDERVEPESCDKTHTCPPCPAPEAEGAPSVFLFP<br>PEPEDTLMISRTPEVTCVVVDVSHEDPEVKFNWYVDGVEVHNAKTKPREE<br>QYNSTYRVVSVLTVLHQDWLNGKEYKCKVSNKALPSSIEKTISKAKGQPR<br>EPQVYTLPPSREEMTENQVSLTCLVKGFYPSDIAVEWESNGQPENNYKTT<br>PPVLDSDGSFFLYSKLTVDKSRWQQGNVESCSVMHEALHNHYTQESLSLS<br>PG* |
| 111 | 13A3<br>(P102Y) | IgG1.1f HC<br>(no C-<br>terminal<br>K) | QLQLQESGPGLVKPSETLSLTCTVSGGSISSRSYYWGWIRQPPGEGLEWI<br>GSIYYSGFTYYNPSLKSRVTISVDTSKNQFSLELSSVTAADTAVYYCATG<br>GPYGDYAHWFDYWGQGTLVTVSSASTEGPSVFPLAPSSESTSGGTAALGC<br>LVEDYFPEPVTVSWNSGALTSGVHTFPAVLQSSGLYSLSSVVTVPSSSLG<br>TQTYICNVNHEPSNTEVDERVEPESCDKTHTCPPCPAPEAEGAPSVFLFP<br>PEPEDTLMISRTPEVTCVVVDVSHEDPEVKFNWYVDGVEVHNAKTKPREE<br>QYNSTYRVVSVLTVLHQDWLNGKEYKCKVSNKALPSSIEKTISKAKGQPR<br>EPQVYTLPPSREEMTENQVSLTCLVKGFYPSDIAVEWESNGQPENNYKTT<br>PPVLDSDGSFFLYSKLTVDKSRWQQGNVESCSVMHEALHNHYTQESLSLS<br>PG* |
| 112 | 13A3<br>(P102L) | IgG1.1f HC<br>(no C-<br>terminal<br>K) | QLQLQESGPGLVKPSETLSLTCTVSGGSISSRSYYWGWIRQPPGEGLEWI<br>GSIYYSGFTYYNPSLKSRVTISVDTSKNQFSLELSSVTAADTAVYYCATG<br>GPYGDYAHWFDLWGQGTLVTVSSASTEGPSVFPLAPSSESTSGGTAALGC<br>LVEDYFPEPVTVSWNSGALTSGVHTFPAVLQSSGLYSLSSVVTVPSSSLG<br>TQTYICNVNHEPSNTEVDERVEPESCDKTHTCPPCPAPEAEGAPSVFLFP<br>PEPEDTLMISRTPEVTCVVVDVSHEDPEVKFNWYVDGVEVHNAKTKPREE<br>QYNSTYRVVSVLTVLHQDWLNGKEYKCKVSNKALPSSIEKTISKAKGQPR<br>EPQVYTLPPSREEMTENQVSLTCLVKGFYPSDIAVEWESNGQPENNYKTT<br>PPVLDSDGSFFLYSKLTVDKSRWQQGNVESCSVMHEALHNHYTQESLSLS<br>PG* |
| 113 | 13A3<br>(N60Q,<br>P102Y) | IgG1.1f HC<br>(no C-<br>terminal<br>K) | QLQLQESGPGLVKPSETLSLTCTVSGGSISSRSYYWGWIRQPPGEGLEWI<br>GSIYYSGFTYYQPSLKSRVTISVDTSKNQFSLELSSVTAADTAVYYCATG<br>GPYGDYAHWFDYWGQGTLVTVSSASTEGPSVFPLAPSSESTSGGTAALGC<br>LVEDYFPEPVTVSWNSGALTSGVHTFPAVLQSSGLYSLSSVVTVPSSSLG<br>TQTYICNVNHEPSNTEVDERVEPESCDKTHTCPPCPAPEAEGAPSVFLFP<br>PEPEDTLMISRTPEVTCVVVDVSHEDPEVKFNWYVDGVEVHNAKTKPREE<br>QYNSTYRVVSVLTVLHQDWLNGKEYKCKVSNKALPSSIEKTISKAKGQPR<br>EPQVYTLPPSREEMTENQVSLTCLVKGFYPSDIAVEWESNGQPENNYKTT<br>PPVLDSDGSFFLYSKLTVDKSRWQQGNVESCSVMHEALHNHYTQESLSLS<br>PG* |
| 114 | 8B9<br>(S61P) | IgG1.1f HC<br>(no C-<br>terminal<br>K) | QVQLQESGPGLVKPSETLSLTCTVSGGSISRHYWNWIRQPPGEGLEWIGY<br>IHYSGSTNYNPSLESRVTISVDTSKNQFSLELSSVTAADTAVYYCARDTG<br>YYGMDIWGQGTTVTVSSASTEGPSVFPLAPSSESTSGGTAALGCLVEDYF<br>PEPVTVSWNSGALTSGVHTFPAVLQSSGLYSLSSVVTVPSSSLGTQTYIC<br>NVNHEPSNTEVDERVEPESCDKTHTCPPCPAPEAEGAPSVFLEPPEPEDT<br>LMISRTPEVTCVVVDVSHEDPEVKFNWYVDGVEVHNAKTKPREEQYNSTY<br>RVVSVLTVLHQDWLNGKEYKCKVSNKALPSSIEKTISKAKGQPREPQVYT<br>LPPSREEMTENQVSLTCLVKGFYPSDIAVEWESNGQPENNYKTTPPVLDS<br>DGSFFLYSKLTVDKSRWQQGNVESCSVMHEALHNHYTQESLSLSPG* |
| 115 | 9F6<br>(A108T) | IgG1.1f HC<br>(no C-<br>terminal<br>K) | QVQLVESGGGLVEPGGSLRLSCAASGFTESDYYMSWIRQAPGEGLEWVSF<br>ISGGGSTITYADSVEGRETISRDNAHNSLELQMNSLRVEDTAVYYCARDG<br>YSSGWYTYGMDVWGQGTTVTVSSASTEGPSVFPLAPSSESTSGGTAALGC<br>LVEDYFPEPVTVSWNSGALTSGVHTFPAVLQSSGLYSLSSVVTVPSSSLG<br>TQTYICNVNHEPSNTEVDERVEPESCDKTHTCPPCPAPEAEGAPSVFLFP<br>PEPEDTLMISRTPEVTCVVVDVSHEDPEVKFNWYVDGVEVHNAKTKPREE<br>QYNSTYRVVSVLTVLHQDWLNGKEYKCKVSNKALPSSIEKTISKAKGQPR<br>EPQVYTLPPSREEMTENQVSLTCLVKGFYPSDIAVEWESNGQPENNYKTT<br>PPVLDSDGSFFLYSKLTVDKSRWQQGNVESCSVMHEALHNHYTQESLSLS<br>PG* |
| 116 | 13A3<br>(N60Q) | IgG1.3f HC | QLQLQESGPGLVKPSETLSLTCTVSGGSISSRSYYWGWIRQPPGEGLEWI<br>GSIYYSGFTYYQPSLKSRVTISVDTSKNQFSLKLSSVTAADTAVYYCATG<br>GPYGDYAHWFDPWGQGTLVTVSSASTEGPSVFPLAPSSESTSGGTAALGC<br>LVEDYFPEPVTVSWNSGALTSGVHTFPAVLQSSGLYSLSSVVTVPSSSLG<br>TQTYICNVNHEPSNTEVDERVEPESCDKTHTCPPCPAPEAEGAPSVFLFP<br>PEPEDTLMISRTPEVTCVVVDVSHEDPEVKFNWYVDGVEVHNAKTKPREE<br>QYNSTYRVVSVLTVLHQDWLNGKEYKCKVSNKALPAPIEKTISKAKGQPR<br>EPQVYTLPPSREEMTENQVSLTCLVKGFYPSDIAVEWESNGQPENNYKTT |

TABLE 8-continued

| SEQ ID | Antibody | Description | Sequences |
|---|---|---|---|
| | | | PPVLDSDGSFFLYSKLTVDKSRWQQGNVESCSVMHEALHNHYTQESLSLSPGK* |
| 117 | 13A3 (N60S) | IgG1.3f HC | QLQLQESGPGLVKPSETLSLTCTVSGGSISSRSYYWGWIRQPPGEGLEWIGSIYYSGFTYYSPSLKSRVTISVDTSKNQFSLKLSSVTAADTAVYYCATGGPYGDYAHWFDPWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVKGFYPSDIAVEWESNGQPENNYKTTPPVLDSDGSFFLYSKLTVDKSRWQQGNVESCSVMHEALHNHYTQESLSLSPGK* |
| 118 | 13A3 (N60A) | IgG1.3f HC | QLQLQESGPGLVKPSETLSLTCTVSGGSISSRSYYWGWIRQPPGEGLEWIGSIYYSGFTYYAPSLKSRVTISVDTSKNQFSLKLSSVTAADTAVYYCATGGPYGDYAHWFDPWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVKGFYPSDIAVEWESNGQPENNYKTTPPVLDSDGSFFLYSKLTVDKSRWQQGNVESCSVMHEALHNHYTQESLSLSPGK* |
| 119 | 13A3 (D101E) | IgG1.3f HC | QLQLQESGPGLVKPSETLSLTCTVSGGSISSRSYYWGWIRQPPGEGLEWIGSIYYSGFTYYNPSLKSRVTISVDTSKNQFSLKLSSVTAADTAVYYCATGGPYGDYAHWEEPWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVKGFYPSDIAVEWESNGQPENNYKTTPPVLDSDGSFFLYSKLTVDKSRWQQGNVESCSVMHEALHNHYTQESLSLSPGK* |
| 120 | 13A3 (P102V) | IgG1.3f HC | QLQLQESGPGLVKPSETLSLTCTVSGGSISSRSYYWGWIRQPPGEGLEWIGSIYYSGFTYYNPSLKSRVTISVDTSKNQFSLKLSSVTAADTAVYYCATGGPYGDYAHWEDVWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVKGFYPSDIAVEWESNGQPENNYKTTPPVLDSDGSFFLYSKLTVDKSRWQQGNVESCSVMHEALHNHYTQESLSLSPGK* |
| 121 | 13A3 (P102Y) | IgG1.3f HC | QLQLQESGPGLVKPSETLSLTCTVSGGSISSRSYYWGWIRQPPGEGLEWIGSIYYSGFTYYNPSLKSRVTISVDTSKNQFSLKLSSVTAADTAVYYCATGGPYGDYAHWFDYWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVKGFYPSDIAVEWESNGQPENNYKTTPPVLDSDGSFFLYSKLTVDKSRWQQGNVESCSVMHEALHNHYTQESLSLSPGK* |
| 122 | 13A3 (P102L) | IgG1.3f HC | QLQLQESGPGLVKPSETLSLTCTVSGGSISSRSYYWGWIRQPPGEGLEWIGSIYYSGFTYYNPSLKSRVTISVDTSKNQFSLKLSSVTAADTAVYYCATGGPYGDYAHWFDLWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVKGFYPSDIAVEWESNGQPENNYKTTPPVLDSDGSFFLYSKLTVDKSRWQQGNVESCSVMHEALHNHYTQESLSLSPGK* |
| 123 | 13A3 (N60Q, P102Y) | IgG1.3f HC | QLQLQESGPGLVKPSETLSLTCTVSGGSISSRSYYWGWIRQPPGEGLEWIGSIYYSGFTYYQPSLKSRVTISVDTSKNQFSLELSSVTAADTAVYYCATGGPYGDYAHWFDYWGQGTLVTVSSASTEGPSVFPLAPSSESTSGGTAALGCLVEDYFPEPVTVSWNSGALTSGVHTFPAVLQSSGLYSLSSVVTVPSSSLGTQTYICNVNHEPSNTEVDERVEPESCDKTHTCPPCPAPEAEGAPSVFLFPPEPEDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVKGFYPSDIAVEWESNGQPENNYKTT |

TABLE 8-continued

| SEQ ID | Antibody | Description | Sequences |
|---|---|---|---|
| | | | PPVLDSDGSFFLYSKLTVDKSRWQQGNVFSCSVMHEALHNHYTQESLSLS PGK* |
| 124 | 8B9 (S61P) | IgG1.3f HC | QVQLQESGPGLVKPSETLSLTCTVSGGSISRHYWNWIRQPPGEGLEWIGY IHYSGSTNYNPSLESRVTISVDTSKNQFSLELSSVTAADTAVYYCARDTG YYGMDIWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPESCDKTHTCPPCPAPEAEGAPSVFLEPPEPEDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSREEMTENQVSLTCLVKGFYPSDIAVEWESNGQPENNYKTTPPVLDS DGSFFLYSKLTVDKSRWQQGNVESCSVMHEALHNHYTQESLSLSPGK* |
| 125 | 9F6 (A108T) | IgG1.3f HC | QVQLVESGGGLVEPGGSLRLSCAASGFTESDYYMSWIRQAPGEGLEWVSF ISGGGSTITYADSVEGRFTISRDNAHNSLFLQMNSLRVEDTAVYYCARDG YSSGWYTYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PGK* |
| 126 | 13A3 (N60Q) | IgG1.3f HC (no C-terminal K) | QLQLQESGPGLVKPSETLSLTCTVSGGSISSRSYYWGWIRQPPGEGLEWI GSIYYSGFTYYQPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PG* |
| 127 | 13A3 (N60S) | IgG1.3f HC (no C-terminal K) | QLQLQESGPGLVKPSETLSLTCTVSGGSISSRSYYWGWIRQPPGEGLEWI GSIYYSGFTYYSPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PG* |
| 128 | 13A3 (N60A) | IgG1.3f HC (no C-terminal K) | QLQLQESGPGLVKPSETLSLTCTVSGGSISSRSYYWGWIRQPPGEGLEWI GSIYYSGFTYYAPSLKSRVTISVDTSKNQFSLELSSVTAADTAVYYCATG GPYGDYAHWFDPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVESCSVMHEALHNHYTQESLSLS PG* |
| 129 | 13A3 (D101E) | IgG1.3f HC (no C-terminal K) | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWEEPWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 130 | 13A3 (P102V) | IgG1.3f HC (no C-terminal K) | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDVWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR |

TABLE 8-continued

| SEQ ID | Antibody | Description | Sequences |
|---|---|---|---|
| | | | EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 131 | 13A3 (P102Y) | IgG1.3f HC (no C-terminal K) | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDYWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 132 | 13A3 (P102L) | IgG1.3f HC (no C-terminal K) | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDLWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 133 | 13A3 (N60Q, P102Y) | IgG1.3f HC (no C-terminal K) | QLQLQESGPGLVKPSETLSLTCTVSGGSISSRSYYWGWIRQPPGEGLEWI GSIYYSGFTYYQPSLKSRVTISVDTSKNQFSLELSSVTAADTAVYYCATG GPYGDYAHWFDYWGQGTLVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 134 | 8B9 (S61P) | IgG1.3f HC (no C-terminal K) | QVQLQESGPGLVKPSETLSLTCTVSGGSISRHYWNWIRQPPGEGLEWIGY IHYSGSTNYNPSLKSRVTISVDTSKNQFSLELSSVTAADTAVYYCARDTG YYGMDIWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDERVEPKSCDKTHTCPPCPAPEAEGAPSVFLFPPEPEDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSREEMTENQVSLTCLVKGFYPSDIAVEWESNGQPENNYKTTPPVLDS DGSFFLYSKLTVDKSRWQQGNVFSCSVMHEALHNHYTQESLSLSPG* |
| 135 | 9F6 (A108T) | IgG1.3f HC (no C-terminal K) | QVQLVESGGGLVEPGGSLRLSCAASGFTFSDYYMSWIRQAPGEGLEWVSF ISGGGSTITYADSVEGRFTISRDNAHNSLFLQMNSLRVEDTAVYYCARDG YSSGWYTYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSREEMTENQVSLTCLVKGFYPSDIAVEWESNGQPENNYKTT PPVLDSDGSFFLYSKLTVDKSRWQQGNVFSCSVMHEALHNHYTQESLSLS PG* |
| 136 | 13A3 | hIgG4 HC | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDPWGQGTLVTVSSASTEGPSVFPLAPCSRSTSESTAALGC LVKDYFPEPVTVSWNSGALTSGVHTFPAVLQSSGLYSLSSVVTVPSSSLG TETYTCNVDHEPSNTEVDERVESKYGPPCPSCPAPEFLGGPSVFLFPPEP EDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDHSRWQEGNVFSCSVMHEALHNHYTQKSLSLSLGK * |
| 137 | 13A3 | hIgG4 HC (without C-terminal K) | QLQLQESGPGLVKPSETLSLTCTVSGGSISSRSYYWGWIRQPPGKGLEWI GSIYYSGFTYYNPSLKSRVTISVDTSKNQFSLKLSSVTAADTAVYYCATG GPYGDYAHWFDPWGQGTLVTVSSASTKGPSVFPLAPCSRSTSESTAALGC LVKDYFPEPVTVSWNSGALTSGVHTFPAVLQSSGLYSLSSVVTVPSSSLG THTYTCNVDHKPSNTKVDKRVESKYGPPCPSCPAPEFLGGPSVFLFPPKP KDTLMISRTPEVTCVVVDVSQEDPEVQPNWYVDGVEVHNAKTKPREEQFN |

TABLE 8-continued

| SEQ ID | Antibody | Description | Sequences |
|---|---|---|---|
| | | | STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLG* |
| 138 | TIM3.5-13A3 | IgG4P HC | QLQLQESGPGLVKPSETLSLTCTVSGGSISSRSYYWGWIRQPPGKGLEWI GSIYYSGFTYYNPSLKSRVTISVDTSKNQFSLKLSSVTAADTAVYYCATG GPYGDYAHWFDPWGQGTLVTVSSASTKGPSVFPLAPCSRSTSESTAALGC LVKDYFPEPVTVSWNSGALTSGVHTFPAVLQSSGLYSLSSVVTVPSSSLG THTYTCNVDHKPSNTKVDKRVESKYGPPCPPCPAPEFLGGPSVFLFPPKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDHSRWQEGNVFSCSVMHEALHNHYTQKSLSLSLGK* |
| 139 | TIM3.5-13A3 | IgG4P HC (without C-terminal K) | QLQLQESGPGLVKPSETLSLTCTVSGGSISSRSYYWGWIRQPPGKGLEWI GSIYYSGFTYYNPSLKSRVTISVDTSKNQFSLKLSSVTAADTAVYYCATG GPYGDYAHWFDPWGQGTLVTVSSASTKGPSVFPLAPCSRSTSESTAALGC LVKDYFPEPVTVSWNSGALTSGVHTFPAVLQSSGLYSLSSVVTVPSSSLG THTYTCNVDHKPSNTKVDKRVESKYGPPCPPCPAPEFLGGPSVFLFPPKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLG* |
| 140 | TIM3.10-13A3 (N60Q) | IgG4P HC | QLQLQESGPGLVKPSETLSLTCTVSGGSISSRSYYWGWIRQPPGKGLEWI GSIYYSGFTYYQPSLKSRVTISVDTSKNQFSLKLSSVTAADTAVYYCATG GPYGDYAHWFDPWGQGTLVTVSSASTKGPSVFPLAPCSRSTSESTAALGC LVKDYFPEPVTVSWNSGALTSGVHTFPAVLQSSGLYSLSSVVTVPSSSLG THTYTCNVDHKPSNTKVDKRVESKYGPPCPPCPAPEFLGGPSVFLFPPKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDHSRWQEGNVFSCSVMHEALHNHYTQKSLSLSLGK* |
| 141 | TIM3.10-13A3 (N60Q) | IgG4P HC (without C-terminal K) | QLQLQESGPGLVKPSETLSLTCTVSGGSISSRSYYWGWIRQPPGKGLEWI GSIYYSGFTYYQPSLKSRVTISVDTSKNQFSLKLSSVTAADTAVYYCATG GPYGDYAHWFDPWGQGTLVTVSSASTKGPSVFPLAPCSRSTSESTAALGC LVKDYFPEPVTVSWNSGALTSGVHTFPAVLQSSGLYSLSSVVTVPSSSLG THTYTCNVDHKPSTKVDKRVESKYGPPCPPCPAPEFLGGPSVFLFPPIKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLG* |
| 142 | TIM3.11-13A3 (N60S) | IgG4P HC | QLQLQESGPGLVKPSETLSLTCTVSGGSISSRSYYWGWIRQPPGKGLEWI GSIYYSGFTYYSPSLKSRVTISVDTSKNQFSLKLSSVTAADTAVYYCATG GPYGDYAHWFDPWGQGTLVTVSSASTKGPSVFPLAPCSRSTSESTAALGC LVKDYFPEPVTVSWNSGALTSGVHTFPAVLQSSGLYSLSSVVTVPSSSLG THTYTCNVDHKPSNTKVDKRVESKYGPPCPPCPAPEFLGGPSVFLFPPKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDHSRWQEGNVFSCSVMHEALHNHYTQKSLSLSLGK* |
| 143 | TIM3.11-13A3 (N60S) | IgG4P HC (without C-terminal K) | QLQLQESGPGLVKPSETLSLTCTVSGGSISSRSYYWGWIRQPPGKGLEWI GSIYYSGFTYYSPSLKSRVTISVDTSKNQFSLKLSSVTAADTAVYYCATG GPYGDYAHWFDPWGQGTLVTVSSASTKGPSVFPLAPCSRSTSESTAALGC LVKDYFPEPVTVSWNSGALTSGVHTFPAVLQSSGLYSLSSVVTVPSSSLG THTYTCNVDHPSNTKVDKRVESKYGPPCPPCPAPEFLGGPSVFLFPPIKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLG* |
| 144 | TIM3.12-13A3 (N60A) | IgG4P HC | QLQLQESGPGLVKPSETLSLTCTVSGGSISSRSYYWGWIRQPPGKGLEWI GSIYYSGFTYYAPSLKSRVTISVDTSKNQFSLKLESVTAADTAVYYCATG GPYGDYAHWFDPWGQGTLVTVSSASTEGPSVFPLAPCSRSTSESTAALGC LVEDYFPEPVTVEWNSGALTSGVHTFPAVLQSSGLYSLESVVTVPSSELG TETYTCNVDHEPENTEVDERVESKYGPPCPPCPAPEFLGGPSVFLEPPEP EDTLMISRTPEVTCVVVDVSQEDPEVQFWYVDGVEVHNAKTKPREEQFN STYRVVEVLTVLHQDWLNGKEYKCKVSNEGLPSSIEKTISKAKGQPREPQ VYTLPPSQEEMTENQVSLTCLVKGFYPSDIAVEWESNGQPENNYKTTPPV LDSDGEFFLYSRLTVDKSRWQEGNVESCSVMHEALHNHYTQKSLKLSLGK* |

TABLE 8-continued

| SEQ ID | Antibody | Description | Sequences |
|---|---|---|---|
| 145 | TIM3.12-13A3 (N60A) | IgG4P HC (without C-terminal K) | QLQLQESGPGLVKPSETLSLTCTVEGGSISSRSYYWGWIRQPPGEGLEWI GSIYYSGFTYYAPSLKSRVTISVDTSKNQFSLKLESVTAADTAVYYCATG GPYGDYAHWFDPWGQGTLVTVSSASTEGPSVFPLAPCSRSTSESTAALGC LVEDYFPEPVTVEWNSGALTSGVHTFPAVLQSSGLYSLESVVTVPSSELG TETYTCNVDHEPENTEVDERVESKYGPPCPPCPAPEFLGGPSVFLFPPKP EDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQKSLSLSLG* |
| 146 | TIM3.13-13A3 (D101E) | IgG4P HC | QLQLQESGPGLVKPSETLSLTCTVEGGSISSRSYYWGWIRQPPGEGLEWI GSIYYSGFTYYNPSLKSRVTISVDTSKNQFSLKLESVTAADTAVYYCATG GPYGDYAHWEEPWGQGTLVTVSSASTEGPSVFPLAPCSRSTSESTAALGC LVEDYFPEPVTVEWNSGALTSGVHTFPAVLQSSGLYSLESVVTVPSSELG TETYTCNVDHEPENTEVDERVESKYGPPCPPCPAPEFLGGPSVFLFPPKP EDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQKSLSLSLGK * |
| 147 | TIM3.13-13A3 (D101E) | IgG4P HC (without C-terminal K) | QLQLQESGPGLVKPSETLSLTCTVEGGSISSRSYYWGWIRQPPGEGLEWI GSIYYSGFTYYNPSLKSRVTISVDTSKNQFSLKLESVTAADTAVYYCATG GPYGDYAHWEEPWGQGTLVTVSSASTEGPSVFPLAPCSRSTSESTAALGC LVEDYFPEPVTVEWNSGALTSGVHTFPAVLQSSGLYSLESVVTVPSSELG TETYTCNVDHEPENTEVDERVESKYGPPCPPCPAPEFLGGPSVFLFPPKP EDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQKSLSLSLG* |
| 148 | TIM 3.14-13A3 (P102V) | IgG4P HC | QLQLQESGPGLVKPSETLSLTCTVEGGSISSRSYYWGWIRQPPGEGLEWI GSIYYSGFTYYNPSLKSRVTISVDTSKNQFSLKLESVTAADTAVYYCATG GPYGDYAHWEDVWGQGTLVTVSSASTEGPSVFPLAPCSRSTSESTAALGC LVEDYFPEPVTVEWNSGALTSGVHTFPAVLQSSGLYSLESVVTVPSSELG TETYTCNVDHEPENTEVDERVESKYGPPCPPCPAPEFLGGPSVFLFPPKP EDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQKSLSLSLGK * |
| 149 | TIM 3.14-13A3 (P102V) | IgG4P HC (without C-terminal K) | QLQLQESGPGLVKPSETLSLTCTVEGGSISSRSYYWGWIRQPPGEGLEWI GSIYYSGFTYYNPSLKSRVTISVDTSKNQFSLKLESVTAADTAVYYCATG GPYGDYAHWEDVWGQGTLVTVSSASTEGPSVFPLAPCSRSTSESTAALGC LVEDYFPEPVTVEWNSGALTSGVHTFPAVLQSSGLYSLESVVTVPSSELG TETYTCNVDHEPENTEVDERVESKYGPPCPPCPAPEFLGGPSVFLFPPKP EDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQKSLSLSLG* |
| 150 | TIM3.15-13A3 (P102Y) | IgG4P HC | QLQLQESGPGLVKPSETLSLTCTVEGGSISSRSYYWGWIRQPPGEGLEWI GSIYYSGFTYYNPSLKERVTISVDTSKNQFSLKLESVTAADTAVYYCATG GPYGDYAHWFDYWGQGTLVTVSSASTEGPSVFPLAPCSRSTSESTAALGC LVEDYFPEPVTVEWNSGALTSGVHTFPAVLQSSGLYSLESVVTVPSSELG TETYTCNVDHEPENTEVDERVESKYGPPCPPCPAPEFLGGPSVFLFPPKP EDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQKSLSLSLGK * |
| 151 | TIM3.15-13A3 (P102Y) | IgG4P HC (without C-terminal K) | QLQLQESGPGLVKPSETLSLTCTVEGGSISSRSYYWGWIRQPPGEGLEWI GSIYYSGFTYYNPSLKERVTISVDTSKNQFSLKLESVTAADTAVYYCATG GPYGDYAHWFDWGQGTLVTVSSASTEGPSVFPLAPCSRSTSESTAALGC LVEDYFPEPVTVEWNSGALTSGVHTFPAVLQSSGLYSLESVVTVPSSELG TETYTCNVDHEPENTEVDERVESKYGPPCPPCPAPEFLGGPSVFLFPPKP EDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQESLSLSLG* |
| 152 | TIM3.16-13A3 (P102L) | IgG4P HC | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDLWGQGTLVTVSSASTEGPSVFPLAPCSRSTSESTAALGC |

TABLE 8-continued

| SEQ ID | Antibody | Description | Sequences |
|---|---|---|---|
| | | | LVEDYFPEPVTVSWNSGALTSGVHTFPAVLQSSGLYSLSSVVTVPSSSLG TETYTCNVDHEPSNTEVDERVESKYGPPCPPCPAPEFLGGPSVFLFPPEP EDTLMISRTPEVTCVVVDVSQEDPEVQFNWYVDGVEVHNAKTKPREEQFN STYRVVSVLTVLHQDWLNGKEYKCKVSNEGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQESLSLSLGE* |
| 153 | TIM3.16-13A3 (P102L) | IgG4P HC (without C-terminal K) | QLQLQESGPGLVKPSETLSLTCTVSGGSISSRSYYWGWIRQPPGEGLEWI GSIYYSGFTYYNPSLKSRVTISVDTSKNQFSLELSSVTAADTAVYYCATG GPYGDYAHWFDLWGQGTLVTVSSASTEGPSVFPLAPCSRSTSESTAALGC LVEDYFPEPVTVSWNSGALTSGVHTFPAVLQSSGLYSLSSVVTVPSSSLG TETYTCNVDHEPSNTEVDERVESKYGPPCPPCPAPEFLGGPSVFLFPPEP EDTLMISRTPEVTCVVVDVSQEDPEVQFNWYVDGVEVHNAKTKPREEQFN STYRVVSVLTVLHQDWLNGKEYKCKVSNEGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQESLSLSLG* |
| 154 | TIM3.17-13A3 (N60Q, P102Y) | IgG4P HC | QLQLQESGPGLVKPSETLSLTCTVSGGSISSRSYYWGWIRQPPGEGLEWI GSIYYSGFTYYQPSLKSRVTISVDTSKNQFSLELSSVTAADTAVYYCATG GPYGDYAHWFDLWGQGTLVTVSSASTEGPSVFPLAPCSRSTSESTAALGC LVEDYFPEPVTVSWNSGALTSGVHTFPAVLQSSGLYSLSSVVTVPSSSLG TETYTCNVDHEPSNTEVDERVESKYGPPCPPCPAPEFLGGPSVFLFPPEP EDTLMISRTPEVTCVVVDVSQEDPEVQFNWYVDGVEVHNAKTKPREEQFN STYRVVSVLTVLHQDWLNGKEYKCKVSNEGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQESLSLSLGE* |
| 155 | TIM3.17-13A3 (N60Q, P102Y) | IgG4P HC (without C-terminal K) | QLQLQESGPGLVKPSETLSLTCTVSGGSISSRSYYWGWIRQPPGEGLEWI GSIYYSGFTYYQPSLKSRVTISVDTSKNQFSLELSSVTAADTAVYYCATG GPYGDYAHWFDLWGQGTLVTVSSASTEGPSVFPLAPCSRSTSESTAALGC LVEDYFPEPVTVSWNSGALTSGVHTFPAVLQSSGLYSLSSVVTVPSSSLG TETYTCNVDHEPSNTEVDERVESKYGPPCPPCPAPEFLGGPSVFLFPPEP EDTLMISRTPEVTCVVVDVSQEDPEVQFNWYVDGVEVHNAKTKPREEQFN STYRVVSVLTVLHQDWLNGKEYKCKVSNEGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQESLSLSLG* |
| 156 | 8B9 | IgG1za HC | QVQLQESGPGLVKPSETLSLTCTVSGGSISRHYWNWIRQPPGEGLEWIGY IHYSGSTNYNSSLESRVTISVDTSKNQFSLELSSVTAADTAVYYCARDTG YYGMDIWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDEKVEPESCDKTHTCPPCPAPELLGGPSVFLFPPEPEDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSRDELTENQVSLTCLVKGFYPSDIAVEWESNGQPENNYKTTPPVLDS DGSFFLYSKLTVDKSRWQQGNVFSCSVMHEALHNHYTQESLSLSPGK* |
| 157 | 8B9 | IgG1za HC (without C-terminal K) | QVQLQESGPGLVKPSETLSLTCTVSGGSISRHYWNWIRQPPGEGLEWIGY IHYSGSTNYNSSLESRVTISVDTSKNQFSLELSSVTAADTAVYYCARDTG YYGMDIWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDEKVEPESCDKTHTCPPCPAPELLGGPSVFLFPPEPEDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSRDELTENQVSLTCLVKGFYPSDIAVEWESNGQPENNYKTTPPVLDS DGSFFLYSKLTVDKSRWQQGNVFSCSVMHEALHNHYTQESLSLSPG* |
| 158 | 8B9 | IgG4P HC | QVQLQESGPGLVKPSETLSLTCTVSGGSISRHYWNWIRQPPGEGLEWIGY IHYSGSTNYNSSLESRVTISVDTSKNQFSLELSSVTAADTAVYYCARDTG YYGMDIWGQGTTVTVSSASTEGPSVFPLAPCSRSTSESTAALGCLVEDYF PEPVTVSWNSGALTSGVHTFPAVLQSSGLYSLSSVVTVPSSSLGTETYTC NVDHEPSNTEVDERVESKYGPPCPPCPAPEFLGGPSVFLFPPEPEDTLMI SRTPEVTCVVVDVSQEDPEVQFNWYVDGVEVHNAKTKPREEQFNSTYRVV SVLTVLHQDWLNGKEYKCKVSNEGLPSSIEKTISKAKGQPREPQVYTLPP SQEEMTENQVSLTCLVKGFYPSDIAVEWESNGQPENNYKTTPPVLDSDGS FFLYSRLTVDKSRWQEGNVFSCSVMHEALHNHYTQESLSLSLGE* |
| 159 | 8B9 | IgG4P HC (without C-terminal K) | QVQLQESGPGLVKPSETLSLTCTVSGGSISRHYWNWIRQPPGEGLEWIGY IHYSGSTNYNSSLESRVTISVDTSKNQFSLELSSVTAADTAVYYCARDTG YYGMDIWGQGTTVTVSSASTEGPSVFPLAPCSRSTSESTAALGCLVEDYF PEPVTVSWNSGALTSGVHTFPAVLQSSGLYSLSSVVTVPSSSLGTETYTC NVDHEPSNTEVDERVESKYGPPCPPCPAPEFLGGPSVFLFPPEPEDTLMI SRTPEVTCVVVDVSQEDPEVQFNWYVDGVEVHNAKTKPREEQFNSTYRVV |

TABLE 8-continued

| SEQ ID | Antibody | Description | Sequences |
|---|---|---|---|
| | | | SVLTVLHQDWLNGKEYKCKVSNEGLPSSIEKTISKAKGQPREPQVYTLPP SQEEMTENQVSLTCLVKGFYPSDIAVEWESNGQPENNYKTTPPVLDSDGS FFLYSRLTVDKSRWQEGNVESCSVMHEALHNHYTQESLSLSLG* |
| 160 | TIM3.8-8B9 (S61P) | IgG4P HC | QVQLQESGPGLVKPSETLSLTCTVSGGSISRHYWNWIRQPPGEGLEWIGY IHYSGSTNYNPSLESRVTISVDTSKNQFSLELSSVTAADTAVYYCARDTG YYGMDIWGQGTTVTVSSASTEGPSVFPLAPCSRSTSESTAALGCLVEDYF PEPVTVSWNSGALTSGVHTFPAVLQSSGLYSLSSVVTVPSSSLGTETYTC NVDHEPSNTEVDERVESKYGPPCPPCPAPEFLGGPSVFLFPPEPEDTLMI SRTPEVTCVVVDVSQEDPEVQFNWYVDGVEVHNAKTKPREEQFNSTYRVV SVLTVLHQDWLNGKEYKCKVSNEGLPSSIEKTISKAKGQPREPQVYTLPP SQEEMTENQVSLTCLVKGFYPSDIAVEWESNGQPENNYKTTPPVLDSDGS FFLYSRLTVDKSRWQEGNVESCSVMHEALHNHYTQESLSLSLGK* |
| 161 | TIM3.8-8B9 (S61P) | IgG4P HC (without C-terminal K) | QVQLQESGPGLVKPSETLSLTCTVSGGSIRHYWNWIRQPPGEGLEWIGY IHYSGSTNYNPSLESRVTISVDTSKNQFSLELSSVTAADTAVYYCARDTG YYGMDIWGQGTTVTVSSASTEGPSVFPLAPCSRSTSESTAALGCLVEDYF PEPVTVSWNSGALTSGVHTFPAVLQSSGLYSLSSVVTVPSSSLGTETYTC NVDHEPSNTEVDERVESKYGPPCPPCPAPEFLGGPSVFLEPPEPEDTLMI SRTPEVTCVVVDVSQEDPEVQFNWYVDGVEVHNAKTKPREEQFNSTYRVV SVLTVLHQDWLNGKEYKCKVSNEGLPSSIEKTISKAKGQPREPQVYTLPP SQEEMTENQVSLTCLVKGFYPSDIAVEWESNGQPENNYKTTPPVLDSDGS FFLYSRLTVDKSRWQEGNVESCSVMHEALHNHYTQESLSLSLG* |
| 162 | 8C4 | IgG1za HC | QVQLQESGPGLVKPSETLSLTCTVSGGSISRYYWSWIRQPPGEGLEWIGY IHYTGSTNYNPSLESRVTISVDTSKNQFSLELSSVTAADTAVYYCATDTG YYGMDVWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDEKVEPESCDKTHTCPPCPAPELLGGPSVFLEPPEPEDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSRDELTENQVSLTCLVKGFYPSDIAVEWESNGQPENNYKTTPPVLDS DGSFFLYSKLTVDKSRWQQGNVESCSVMHEALHNHYTQESLSLSPGK* |
| 163 | 8C4 | IgG1za HC (without C-terminal K) | QVQLQESGPGLVKPSETLSLTCTVSGGSISRYYWSWIRQPPGEGLEWIGY IHYTGSTNYNPSLESRVTISVDTSKNQFSLELSSVTAADTAVYYCATDTG YYGMDVWGQGTTVTVSSASTEGPSVFPLAPSSESTSGGTAALGCLVEDYF PEPVTVSWNSGALTSGVHTFPAVLQSSGLYSLSSVVTVPSSSLGTQTYIC NVNHEPSNTEVDEKVEPESCDKTHTCPPCPAPELLGGPSVFLEPPEPEDT LMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYT LPPSRDELTENQVSLTCLVKGFYPSDIAVEWESNGQPENNYKTTPPVLDS DGSFFLYSKLTVDKSRWQQGNVESCSVMHEALHNHYTQESLSLSPG* |
| 164 | TIM3.6-8C4 | IgG4P HC | QVQLQESGPGLVKPSETLSLTCTVSGGSISRYYWSWIRQPPGEGLEWIGY IHYTGSTNYNPSLESRVTISVDTSKNQFSLELSSVTAADTAVYYCATDTG YYGMDVWGQGTTVTVSSSTETYTCNVDHEPSNTEVDERVESKYGPPCPPC APEFLGGPSVFLEPPEPEDTLMISRTPEVTCVVVDVSQEDPEVQFNWYVD GVEVHNAKTKPREEQFNSTYRVVSVLTVLHQDWLNGKEYKCKVSNEGLPS SIEKTISKAKGQPREPQVYTLPPSQEEMTENQVSLTCLVKGFYPSDIAVE WESNGQPENNYKTTPPVLDSDGSFFLYSRLTVDKSRWQEGNVESCSVMHE ALHNHYTQESLSLSLGK* |
| 165 | TIM3.6-8C4 | IgG4P HC (without C-terminal K) | QVQLQESGPGLVKPSETLSLTCTVSGGSISRYYWSWIRQPPGEGLEWIGY IHYTGSTNYNPSLESRVTISVDTSKNQFSLELSSVTAADTAVYYCATDTG YYGMDVWGQGTTVTVSSSTETYTCNVDHEPSNTEVDERVESKYGPPCPPC APEFLGGPSVFLEPPEPEDTLMISRTPEVTCVVVDVSQEDPEVQFNWYVD GVEVHNAKTKPREEQFNSTYRVVSVLTVLHQDWLNGKEYKCKVSNEGLPS SIEKTISKAKGQPREPQVYTLPPSQEEMTENQVSLTCLVKGFYPSDIAVE WESNGQPENNYKTTPPVLDSDGSFFLYSRLTVDKSRWQEGNVESCSVMHE ALHNHYTQESLSLSLG* |
| 166 | 17C3 | IgG1za HC | QVQLVQSGAEVKKPGASVKVSCKASGYTFTSYYMHWVRQAPGQGLEWMGI INPRGDSIIYAQHFQGRVTMTRDTSTSTVYMELSSLRSEDTAVYYCARDF YGSGNYTYGMDVWGQGTTVTVSSASTEGPSVFPLAPSSESTSGGTAALGC LVEDYFPEPVTVSWNSGALTSGVHTFPAVLQSSGLYSLSSVVTVPSSSLG TQTYICNVNHEPSNTEVDEKVEPESCDKTHTCPPCPAPELLGGPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPSRDELTENQVSLTCLVKGFYPSDIAVEWESNGQPENNYKTT PPVLDSDGSFFLYSKLTVDKSRWQQGNVESCSVMHEALHNHYTQESLSLS PGK* |
| 167 | 17C3 | IgG1za HC (without C-terminal K) | QVQLVQSGAEVKKPGASVKVSCKASGYTFTSYYMHWVRQAPGQGLEWMGI INPRGDSIIYAQHFQGRVTMTRDTSTSTVYMELSSLRSEDTAVYYCARDF YGSGNYYYGMDVWGQGTTVTVSSASTKGPSVFPLAPSSKSTSGGTAALGC LVKDYFPEPVTVSWNSGALTSGVHTFPAVLQSSGLYSLSSVVTVPSSSLG |

TABLE 8-continued

| SEQ ID | Antibody | Description | Sequences |
|---|---|---|---|
| | | | TQTYICNVNETKPSNTKVDKWEPHSCDKTHTCPPCPAPELLGGPSVFLFP<br>PKPFDTLMISRTPEVTCVVVDVSHEDPEVKFNWYVDGVEVHNAKTKPREE<br>QYNSTYRVVSVLTVLHQDWLNGKEYKCKVSNKALPAPIEKTISKAKGQPR<br>EPQVYTLPPSRDELTKNQVSLTCLVKGFYPSDIAVEWESNGQPENNYKTT<br>PPVLDSDGSFFLYSKLTVDKSRWQQGNVFSCSVMHEALHNHYTQKSLSLS<br>PG* |
| 168 | TIM3.2-17C3 | IgG4P HC | QVQLVQSGAEVKKPGASVIWSCKASGYTFTSYYMHWVRQAPGQGLEWMGI<br>INPRGDSIIYAQHFQGRVTMTRDTSTSTVYMELSSLRSEDTAVYYCARDF<br>YGSGNYYYGMDVWGQGTTVTVSSASTKGPSVFPLAPCSRSTSESTAALGC<br>LVKDYFPEPVTVSWNSGALTSGVHTFPAVLQSSGLYSLSSVVTVPSSSLG<br>TKTYTCNVDHKPSNTKVDKRVESKYGPPCPPCPAPEFLGGPSVFLFPPKP<br>KDTLMISRTPEVTCVVVDVSQEDPEVQFNWYVDGVEVHNAKTKPREEQFN<br>STYRVVSVLTVLHQDWLNGKEYKCKVSNKGLPSSIEKTISKAKGQPREPQ<br>VYTLPPSQEEMTKNQVSLTCLVKGFYPSDIAVEWESNGQPENNYKTTPPV<br>LDSDGSFFLYSRLTVDKSRWQEGNVFSCSVMHEALHNHYTQKSLSLSLGK<br>* |
| 169 | TIM3.2-17C3 | IgG4P HC (without C-terminal K) | QVQLVQSGAEVKKPGASVIWSCKASGYTFTSYYMHWVRQAPGQGLEWMGI<br>INPRGDSIIYAQHFQGRVTMTRDTSTSTVYMELSSLRSEDTAVYYCARDF<br>YGSGNYYYGMDVWGQGTTVTVSSASTKGPSVFPLAPCSRSTSESTAALGC<br>LVKDYFPEPVTVSWNSGALTSGVHTFPAVLQSSGLYSLSSVVTVPSSSLG<br>TKTYTCNVDHKPSNTKVDKRVESKYGPPCPPCPAPEFLGGPSVFLFPPKP<br>KDTLMISRTPEVTCVVVDVSQEDPEVQFNWYVDGVEVHNAKTKPREEQFN<br>STYRVVSVLTVLHQDWLNGKEYKCKVSNKGLPSSIEKTISKAKGQPREPQ<br>VYTLPPSQEEMTKNQVSLTCLVKGFYPSDIAVEWESNGQPENNYKTTPPV<br>LDSDGSFFLYSRLTVDKSRWQEGNVFSCSVMHEALHNHYTQKSLSLSLG* |
| 170 | 9F6 | IgG1za HC | QVQLVESGGGLVKPGGSLRLSCAASGFTFSDYYMSWIRQAPGKGLEWVSF<br>ISGGGSTITYADSVKGRFTISRDNAKNSLFLQMNSLRVEDTAVYYCARDG<br>YSSGWYYYGMDVWGQGTAVTVSSASTKGPSVFPLAPSSKSTSGGTAALGC<br>LVKDYFPEPVTVSWNSGALTSGVHTFPAVLQSSGLYSLSSVVTVPSSSLG<br>TQTYICNVNETKPSNTKVDKWEPHSCDKTHTCPPCPAPELLGGPSVFLFP<br>PKPFDTLMISRTPEVTCVVVDVSHEDPEVKFNWYVDGVEVHNAKTKPREE<br>QYNSTYRVVSVLTVLHQDWLNGKEYKCKVSNKALPAPIEKTISKAKGQPR<br>EPQVYTLPPSRDELTKNQVSLTCLVKGFYPSDIAVEWESNGQPENNYKTT<br>PPVLDSDGSFFLYSKLTVDKSRWQQGNVFSCSVMHEALHNHYTQKSLSLS<br>PGK* |
| 171 | 9F6 | IgG1za HC (without C-terminal K) | QVQLVESGGGLVKPGGSLRLSCAASGFTFSDYYMSWIRQAPGKGLEWVSF<br>ISGGGSTITYADSVKGRFTISRDNAKNSLFLQMNSLRVEDTAVYYCARDG<br>YSSGWYYYGMDVWGQGTAVTVSSASTKGPSVFPLAPSSKSTSGGTAALGC<br>LVKDYFPEPVTVSWNSGALTSGVHTFPAVLQSSGLYSLSSVVTVPSSSLG<br>TQTYICNVNETKPSNTKVDKWEPHSCDKTHTCPPCPAPELLGGPSVFLFP<br>PKPFDTLMISRTPEVTCVVVDVSHEDPEVKFNWYVDGVEVHNAKTKPREE<br>QYNSTYRVVSVLTVLHQDWLNGKEYKCKVSNKALPAPIEKTISKAKGQPR<br>EPQVYTLPPSRDELTKNQVSLTCLVKGFYPSDIAVEWESNGQPENNYKTT<br>PPVLDSDGSFFLYSKLTVDKSRWQQGNVFSCSVMHEALHNHYTQKSLSLS<br>PG* |
| 172 | 9F6 | IgG4P HC | QVQLVESGGGLVKPGGSLRLSCAASGFTFSDYYMSWIRQAPGKGLEWVSF<br>ISGGGSTITYADSVKGRFTISRDNAKNSLFLQMNSLRVEDTAVYYCARDG<br>YSSGWYYYGMDVWGQGTAVTVSSASTKGPSVFPLAPCSRSTSESTAALGC<br>LVKDYFPEPVTVSWNSGALTSGVHTFPAVLQSSGLYSLSSVVTVPSSSLG<br>TKTYTCNVDHKPSNTKVDKRVESKYGPPCPPCPAPEFLGGPSVFLFPPKP<br>KDTLMISRTPEVTCVVVDVSQEDPEVQFNWYVDGVEVHNAKTKPREEQFN<br>STYRVVSVLTVLHQDWLNGKEYKCKVSNKGLPSSIEKTISKAKGQPREPQ<br>VYTLPPSQEEMTKNQVSLTCLVKGFYPSDIAVEWESNGQPENNYKTTPPV<br>LDSDGSFFLYSRLTVDKSRWQEGNVFSCSVMHEALHNHYTQKSLSLSLGK<br>* |
| 173 | 9F6 | IgG4P HC (without C-terminal K) | QVQLVESGGGLVKPGGSLRLSCAASGFTFSDYYMSWIRQAPGKGLEWVSF<br>ISGGGSTITYADSVKGRFTISRDNAKNSLFLQMNSLRVEDTAVYYCARDG<br>YSSGWYYYGMDVWGQGTAVTVSSASTKGPSVFPLAPCSRSTSESTAALGC<br>LVKDYFPEPVTVSWNSGALTSGVHTFPAVLQSSGLYSLSSVVTVPSSSLG<br>TKTYTCNVDHKPSNTKVDKRVESKYGPPCPPCPAPEFLGGPSVFLFPPKP<br>KDTLMISRTPEVTCVVVDVSQEDPEVQFNWYVDGVEVHNAKTKPREEQFN<br>STYRVVSVLTVLHQDWLNGKEYKCKVSNKGLPSSIEKTISKAKGQPREPQ<br>VYTLPPSQEEMTKNQVSLTCLVKGFYPSDIAVEWESNGQPENNYKTTPPV<br>LDSDGSFFLYSRLTVDKSRWQEGNVFSCSVMHEALHNHYTQKSLSLSLG* |
| 174 | TIM3.7-9F6 (A108T) | IgG4P HC | QVQLVESGGGLVKPGGSLRLSCAASGFTFSDYYMSWIRQAPGKGLEWVSF<br>ISGGGSTITYADSVKGRFTISRDNAKNSLFLQMNSLRVEDTAVYYCARDG<br>YSSGWYYYGMDVWGQGTTVTVSSASTKGPSVFPLAPCSRSTSESTAALGC<br>LVKDYFPEPVTVSWNSGALTSGVHTFPAVLQSSGLYSLSSVVTVPSSSLG<br>TKTYTCNVDHKPSNTKVDKRVESKYGPPCPPCPAPEFLGGPSVFLFPPKP<br>KDTLMISRTPEVTCVVVDVSQEDPEVQFNWYVDGVEVHNAKTKPREEQFN |

TABLE 8-continued

| SEQ ID | Antibody | Description | Sequences |
|---|---|---|---|
| | | | STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK* |
| 175 | TIM3.7-9F6 (A108T) | IgG4P HC (without C-terminal K) | QVQLVESGGGLVKPGGSLRLSCAASGFTFSDYYMSWIRQAPGKGLEWVSF ISGGGSTITYADSVKGRFTISRDNAKNSLFLQMNSLRVEDTAVYYCARDG YSSGWYYYGMDVWGQGTTVTVSSASTKGPSVFPLAPCSRSTSESTAALGC LVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLG* |
| 176 | 3G4 | IgG1za HC | QVQLVESGGGLVKPGGSLRLSCAASGFTFSDYYMSWIRQAPGKGLEWVSF ISTSGSIITYADSVKGRFTISRDNAKNSLYLQMNSLRAEDTAVYYCAREG YSSSWSYYYGMDVWGQGTTVTVSSASTKGPSVFPLAPSSKSTSGGTAALG CLVKDYFPEPVTVSWNSGALTSGVHTFPAVLQSSGLYSLSSVVTVPSSSL GTQTYICNVTHIKPSNTKVDKWEPHSCDKTHTCPPCPAPELLGGPSVFLF PPKPFDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQP REPQVYTLPPSRDELTKNQVSLTCLVKGFYPSDIAVEWESNGQPENNYHT TPPVLDSDGSFFLYSKLTVDKSRWQQGNVFSCSVMHEALHNHYTQKSLSL SPGK* |
| 177 | 3G4 | IgG1za HC (without C-terminal K) | QVQLVESGGGLVKPGGSLRLSCAASGFTFSDYYMSWIRQAPGKGLEWVSF ISTSGSIITYADSVKGRFTISRDNAKNSLYLQMNSLRAEDTAVYYCAREG YSSSWSYYYGMDVWGQGTTVTVSSASTKGPSVFPLAPSSKSTSGGTAALG CLVKDYFPEPVTVSWNSGALTSGVHTFPAVLQSSGLYSLSSVVTVPSSSL GTQTYICNVTHKPSNTKVDKWEPHSCDIKTHTCPPCPAPELLGGPSVFLF PPKPFDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQP REPQVYTLPPSRDELTKNQVSLTCLVKGFYPSDIAVEWESNGQPENNYHT TPPVLDSDGSFFLYSKLTVDKSRWQQGNVFSCSVMHEALHNHYTQKSLSL SPG* |
| 178 | TIM3.4-3G4 | IgG4P HC | QVQLVESGGGLVKPGGSLRLSCAASGFTFSDYYMSWIRQAPGKGLEWVSF ISTSGSIITYADSVKGRFTISRDNAKNSLYLQMNSLRAEDTAVYYCAREG YSSSWSYYYGMDVWGQGTTVTVSSASTKGPSVFPLAPCSRSTSESTAALG CLVKDYFPEPVTVSWNSGALTSGVHTFPAVLQSSGLYSLSSVVTVPSSSL GTKTYTCNVDHKPSNTKVDKRVESKYGPPCPPCPAPEFLGGPSVFLFPPK PHDTLMISRTPEVTCVVVDVSQEDPEVQFNWYVDGVEVHNAKTKPREEQF NSTYRVVSVLTVLHQDWLNGKEYKCKVSNKGLPSSIEKTISKAKGQPREP QVYTLPPSQEEMTKNQVSLTCLVKGFYPSDIAVEWESNGQPENNYKTTPP VLDSDGSFFLYSRLTVDKSRWQEGNVFSCSVMHEALHNHYTQKSLSLSLG K* |
| 179 | TIM3.4-3G4 | IgG4P HC (without C-terminal K) | QVQLVESGGGLVKPGGSLRLSCAASGFTFSDYYMSWIRQAPGKGLEWVSF ISTSGSIITYADSVKGRFTISRDNAKNSLYLQMNSLRAEDTAVYYCAREG YSSSWSYYYGMDVWGQGTTVTVSSASTKGPSVFPLAPCSRSTSESTAALG CLVKDYFPEPVTVSWNSGALTSGVHTFPAVLQSSGLYSLSSVVTVPSSSL GTKTYTCNVDHKPSNTKVDKRVESKYGPPCPPCPAPEFLGGPSVFLFPPK PHDTLMISRTPEVTCVVVDVSQEDPEVQFNWYVDGVEVHNAKTKPREEQF NSTYRVVSVLTVLHQDWLNGKEYKCKVSNKGLPSSIEKTISKAKGQPREP QVYTLPPSQEEMTKNQVSLTCLVKGFYPSDIAVEWESNGQPENNYKTTPP VLDSDGSFFLYSRLTVDKSRWQEGNVFSCSVMHEALHNHYTQKSLSLSLG * |
| 180 | 17C8 | IgG4 HC | QVQLVESGGGLVKPGGSLRLSCAASGFTFSDYYMSWIRQAPGKGLEWVSF ISSSGSIITYADSVKGRFTISRDNAKNSLYLQMNSLRAEDTAVYYCARDG YSSGWEYYGMDVWGQGTTVTVSSASTKGPSVFPLAPCSRSTSESTAALGC LVKDYFPEPVTVSWNSGALTSGVHTFPAVLQSSGLYSLSSVVTVPSSSLG TKTYTCNVDHKPSNTKVDKRVESKYGPPCPSCPAPEFLGGPSVFLFPPKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK * |
| 181 | 17C8 | IgG4 HC (without C-terminal K) | QVQLVESGGGLVKPGGSLRLSCAASGFTFSDYYMSWIRQAPGKGLEWVSF ISSSGSIITYADSVKGRFTISRDNAKNSLYLQMNSLRAEDTAVYYCARDG YSSGWEYYGMDVWGQGTTVTVSSASTKGPSVFPLAPCSRSTSESTAALGC LVKDYFPEPVTVSWNSGALTSGVHTFPAVLQSSGLYSLSSVVTVPSSSLG TKTYTCNVDHKPSNTKVDKRVESKYGPPCPSCPAPEFLGGPSVFLFPPKP KDTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ |

TABLE 8-continued

| SEQ ID | Antibody | Description | Sequences |
|---|---|---|---|
| | | | VYTLPPSQEEMTENQVSLTCLVKGFYPSDIAVEWESNGQPENNYKTTPPV LDSDGEFFLYSRLTVDKSRWQEGNVESCSVMHEALHNHYTQESLELSLG* |
| 182 | TIM3.9-17C8 | IgG4P HC | QVQLVESGGGINKPGGSLRLSCAASGETESDYYMSWIRQAPGEGLEWVSF ISSEGSIITYADSVKGRETISRDNAKNSLYLQMNSLRAEDTAVYYCARDG YESGWEYYGMDVWGQGTTVTVSSASTEGPSVFPLAPCSRSTSESTAALGC INEDYFPEPVTVEWNSGALTSGVHTFPAVLQSSGLYSLESVVTVPSSELG TETYTCNVDHEPENTEVDERVESKYGPPCPPCPAPEFLGGPSVFLEPPEP EDTLMISRTPEVTCVVVDVSQEDPEVQFNWYVDGVEVHNAKTKPREEQFN STYRVVSVLTVLHQDWLNGKEYKCKVSNEGLPSSIEKTISKAKGQPREPQ VYTLPPSQEEMTENQVSLTCLVKGFYPSDIAVEWESNGQPENNYKTTPPV LDSDGEFFLYSRLTVDKSRWQEGNVESCSVMHEALHNHYTQKSLKLSLGK* |
| 183 | TIM3.9-17C8 | IgG4P HC (without C-terminal K) | QVQLVESGGGINKPGGSLRLSCAASGETESDYYMSWIRQAPGEGLEWVSF ISSEGSIITYADSVKGRETISRDNAKNSLYLQMNSLRAEDTAVYYCARDG YESGWEYYGMDVWGQGTTVTVSSASTEGPSVFPLAPCSRSTSESTAALGC INEDYFPEPVTVEWNSGALTSGVHTFPAVLQSSGLYSLESVVTVPSSELG TETYTCNVDHEPENTEVDERVESKYGPPCPPCPAPEFLGGPSVFLEPPEP EDTLMISRTPEVTCVVVDVSQEDPEVQFNWYVDGVEVHNAKTKPREEQFN STYRVVSVLTVLHQDWLNGKEYKCKVSNEGLPSSIEKTISKAKGQPREPQ VYTLPPSQEEMTENQVSLTCLVKGFYPSDIAVEWESNGQPENNYKTTPPV LDSDGEFFLYSRLTVDKSRWQEGNVESCSVMHEALHNHYTQKSLKLSLG* |
| 184 | 13A3 (N60Q, D101E) | IgG1.1f HC | QLQLQESGPGINEPSETLELTCTVEGGSISSRSYYWGWIRQPPGEGLEWI GSIYYSGFTYYQPSLKSRVTISVDTSKNQFSLKLESVTAADTAVYYCATG GPYGDYAHWEPWGQGTLVTVSSASTEGPSVFPLAPSSESTSGGTAALGC INEDYFPEPVTVEWNSGALTSGVHTFPAVLQSSGLYSLESVVTVPSSELG TQTYICNVNHEPENTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPEREEMTENQVSLTCLVKGFYPSDIAVEWESNGQPENNYKTT PPVLDSDGEFFLYSKLTVDKSRWQQGNVESCSVMHEALHNHYTQESLELS PGK* |
| 185 | 13A3 (N60Q, D101E) | IgG1.1f HC (no C-terminal K) | QLQLQESGPGINEPSETLELTCTVEGGSISSRSYYWGWIRQPPGEGLEWI GSIYYSGFTYYQPSLKSRVTISVDTSKNQFSLKLESVTAADTAVYYCATG GPYGDYAHWEEPWGQGTLVTVSSASTEGPSVFPLAPSSESTSGGTAALGC INEDYFPEPVTVEWNSGALTSGVHTFPAVLQSSGLYSLESVVTVPSSELG TQTYICNVNHEPENTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPSSIEKTISKAKGQPR EPQVYTLPPEREEMTENQVSLTCLVKGFYPSDIAVEWESNGQPENNYKTT PPVLDSDGEFFLYSKLTVDKSRWQQGNVESCSVMHEALHNHYTQESLKLS PG* |
| 186 | 13A3 (N60Q, D101E) | IgG1.3f HC | QLQLQESGPGINEPSETLELTCTVEGGSISSRSYYWGWIRQPPGEGLEWI GSIYYSGFTYYQPSLKSRVTISVDTSKNQFSLKLESVTAADTAVYYCATG GPYGDYAHWEEPWGQGTLVTVSSASTEGPSVFPLAPSSESTSGGTAALGC INEDYFPEPVTVEWNSGALTSGVHTFPAVLQSSGLYSLESVVTVPSSELG TQTYICNVNHEPENTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPEREEMTENQVSLTCLVKGFYPSDIAVEWESNGQPENNYKTT PPVLDSDGEFFLYSKLTVDKSRWQQGNVESCSVMHEALHNHYTQESLELS PGK* |
| 187 | 13A3 (N60Q, D101E) | IgG1.3f HC (no C-terminal K) | QLQLQESGPGINEPSETLELTCTVEGGSISSRSYYWGWIRQPPGEGLEWI GSIYYSGFTYYQPSLKSRVTISVDTSKNQFSLKLESVTAADTAVYYCATG GPYGDYAHWEEPWGQGTLVTVSSASTEGPSVFPLAPSSESTSGGTAALGC INEDYFPEPVTVEWNSGALTSGVHTFPAVLQSSGLYSLESVVTVPSSELG TQTYICNVNHEPENTEVDERVEPESCDKTHTCPPCPAPEAEGAPSVFLFP PEPEDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPR EPQVYTLPPEREEMTENQVSLTCLVKGFYPSDIAVEWESNGQPENNYKTT PPVLDSDGEFFLYSKLTVDKSRWQQGNVESCSVMHEALHNHYTQESLELS PG* |
| 188 | TIM3.18-13A3 (N60Q, D101E) | IgG4P HC | QLQLQESGPGINEPSETLELTCTVEGGSISSRSYYWGWIRQPPGEGLEWI GSIYYSGFTYYQPSLKSRVTISVDTSKNQFSLKLESVTAADTAVYYCATG GPYGDYAHWEEPWGQGTLVTVSSASTEGPSVFPLAPCSRSTSESTAALGC INEDYFPEPVTVEWNSGALTSGVHTFPAVLQSSGLYSLESVVTVPSSELG TETYTCNVDHEPENTEVDERVESKYGPPCPPCPAPEFLGGPSVFLEPPEP EDTLMISRTPEVTCVVVDVSQEDPEVQFNWYVDGVEVHNAKTKPREEQFN STYRVVSVLTVLHQDWLNGKEYKCKVSNEGLPSSIEKTISKAKGQPREPQ |

TABLE 8-continued

| SEQ ID | Antibody | Description | Sequences |
|---|---|---|---|
| | | | VYTLPPSQEEMTENQVSLTCLVKGFYPSDIAVEWESNGQPENNYKTTPPV LDSDGEFFLYSRLTVDKSRWQEGNVESCSVMHEALHNHYTQKSLKLSLGK * |
| 189 | TIM3.18-13A3 (N60Q, D101E) | IgG4P HC (without C-terminal K) | QLQLQESGPGLVKPSETLSLTCTVSGGSISSRSYYWGWIRQPPGEGLEWI GSIYYSGFTYYQPSLKSRVTISVDTSKNQFSLELSSVTAADTAVYYCATG GPYGDYAHWFEPWGQGTLVTVSSASTEGPSVFPLAPCSRSTSESTAALGC LVEDYFPEPVTVSWNSGALTSGVHTFPAVLQSSGLYSLSSVVTVPSSSLG TETYTCNVDHEPSNTEVDERVESKYGPPCPPCPAPEFLGGPSVFLFPPEP EDTLMISRTPEVTCVVVDVSQEDPEVQFNWYVDGVEVHNAKTKPREEQFN STYRVVSVLTVLHQDWLNGKEYKCKVSNEGLPSSIEKTISKAKGQPREPQ VYTLPPSQEEMTENQVSLTCLVKGFYPSDIAVEWESNGQPENNYKTTPPV LDSDGSFFLYSRLTVDKSRWQEGNVFSCSVMHEALHNHYTQESLSLSLG* |
| 190 | 13A3, 17C3, 3G4 | LC | EIVLTQSPGTLSLSPGERATLSCRASQSVSSSYLAWYQQFPGQAPRLLIY GASSRATGIPDRFSGSGSGTDFTLTISRLEPEDFAVYYCQQYGSSPITFG QGTRLEIHRTVAAPSVFIFPPSDEQLKSGTASVVCLLNNFYPREAKVQWE VDNALQSGNSQESVTEQDSEDSTYSLSSTLTLSKADYEKHEVYACEVTHQ GLSSPVTESFNRGEC* |
| 191 | 8B9, 8C4, 17C8, 9F6 (VK3) | LC | EIVLTQSPGTLSLSPGERATLSCRASQSVSSSYLAWYQQFPGQAPRLLIY GASSRATGIPDRFSGSGSGTDFTLTISRLEPEDFAVYYCQQYGSSPLTFG GGTEVEIHRTVAAPSVFIFPPSDEQLKSGTASVVCLLNNFYPREAKVQWE VDNALQSGNSQESVTEQDSEDSTYSLSSTLTLSKADYEKHEVYACEVTHQ GLSSPVTESFNRGEC* |
| 192 | 9F6 (VK1) | LC | AIQLTQSPSSLSASVGDRVTITCRASQGISSALAWYQQFPGKAPELLIYD ASSLESGVPSRFSGSGSGTDFTLTISSLQPEDFATTYCQQFNSYPRTFGQ GTEVEIHRTVAAPSVFIFPPSDEQLKSGTASVVCLLNNFYPREAKVQWEV DNALQSGNSQESVTEQDSEDSTYSLSSTLTLSKADYEKHEVYACEVTHQG LSSPVTESFNRGECk |
| 193 | 9F6 (VK2) | LC | EIVLTQSPGTLSLSPGERATLSCRASQSVSSSYLAWYQQFPGQAPRLLIY GASSRATGIPDRFSGSGSGTDFTLTISRLEPEDFAVYYCQQYGSSLTFGG GTEVEIHRTVAAPSVFIFPPSDEQLKSGTASVVCLLNNFYPREAKVQWEV DNALQSGNSQESVTEQDSEDSTYSLSSTLTLSKADYEKHEVYACEVTHQG LSSPVTESFNRGEC* |
| 194 | | TIM3 Isoform 1 (aa) | MFSHLPFDCVLLLLLLLLTRSSEVEYRAEVGQNAYLPCFYTPAAPGNLVP VCWGEGACPVFECGNVVLRTDERDVNYWTSRYWLNGDFREGDVSLTIENV TLADSGITCCRIQIPGIMNDEFFNLELVIKPAKVTPAPTRQRDFTAAFPR MLTTRGHGPAETQTLGSLPDINLTQISTLANELRDSRLANDLRDSGATIR IGITIGAGICAGLALALIFGALIFEWYSHSKEKIQNLSLISLANLPPSGL ANAVAEGIRSEENITTIEENVYEVEEPNETYCYVSSRQQPSQPLGCRFAM |
| 195 | | TIM3 Isoform 2 (aa) | MFSHLPFDCVLLLLLLLLTRSSEVEYRAEVGQNAYLPCFYTPAAPGNLVP VCWGEGACPVFECGNVVLRTDERDVNYWTSRYWLNGDFREGDVSLTIENV TLADSGITCCRIQIPGIMNDEFFNLELVIKPGEWTFACHLYE |
| 196 | | TIM3 Isoform 1 (nt) | AGAACACTTACAGGATGTGTGTAGTGTGGCATGACAGAGAACTTTGGTTT CCTTTAATGTGACTGTAGAC CTGGCAGTGTTACTATAAGAATCACTGGCAATCAGACACCCGGGTGTGCT GAGCTAGCACTCAGTGGGGG CGGCTACTGCTCATGTGATTGTGGAGTAGACAGTTGGAAGAAGTACCCAG TCCATTTGGAGAGTTAAAAC TGTGCCTAACAGAGGTGTCCTCTGACTTTTCTTCTGCAAGCTCCATGTTT TCACATCTTCCCTTTGACTG TGTCCTGCTGCTGCTGCTGCTACTACTTACAAGGTCCTCAGAAGTGGAAT ACAGAGCGGAGGTCGGTCAG AATGCCTATCTGCCCTGCTTCTACACCCCAGCCGCCCCAGGGAACCTCGT GCCCGTCTGCTGGGCAAAG GAGCCTGTCCTGTGTTTGAATGTGGCAACGTGGTGCTCAGGACTGATGAA AGGGATGTGAATTATTGGAC ATCCAGATACTGGCTAAATGGGGATTTCCGCAAAGGAGATGTGTCCCTGA CCATAGAGAATGTGACTCTA GCAGACAGTGGGATCTACTGCTGCCGGATCCAAATCCCAGGCATAATGAA TGATGAAAAATTTAACCTGA AGTTGGTCATCAAACCAGCCAAGGTCACCCCTGCACCGACTCGGCAGAGA GACTTCACTGCAGCCTTTCC AAGGATGCTTACCACCAGGGGACATGGCCCAGCAGAGACACAGACACTGG GGAGCCTCCCTGATATAAAT CTAACACAAATATCGACATTGGCCAATGAGTTACGGGACTCTAGATTGGC CAATGACTTACGGGACTCTG GAGCAACCATCAGAATAGGCATCTACATCGGAGCAGGGATCTGTGCTGGG CTGGCTCTGGCTCTTATCTT CGGCGCTTTAATTTTCAAATGGTATTCTCATAGCAAAGAGAAGATACAGA ATTTAAGCCTCATCTCTTTG |

TABLE 8-continued

| SEQ ID | Antibody | Description | Sequences |
|---|---|---|---|
| | | | GCCAACCTCCCTCCCTCAGGATTGGCAAATGCAGTAGCAGAGGGAATTCG<br>CTCAGAAGAAAACATCTATA<br>CCATTGAAGAGAACGTATATGAAGTGGAGGAGCCCAATGAGTATTATTGC<br>TATGTCAGCAGCAGGCAGCA<br>ACCCTCACAACCTTTGGGTTGTCGCTTTGCAATGCCATAGATCCAACCAC<br>CTTATTTTTGAGCTTGGTGT<br>TTTGTCTTTTTCAGAAACTATGAGCTGTGTCACCTGACTGGTTTTGGAGG<br>TTCTGTCCACTGCTATGGAG<br>CAGAGTTTTCCCATTTTCAGAAGATAATGACTCACATGGGAATTGAACTG<br>GGACCTGCACTGAACTTAAA<br>CAGGCATGTCATTGCCTCTGTATTTAAGCCAACAGAGTTACCCAACCCAG<br>AGACTGTTAATCATGGATGT<br>TAGAGCTCAAACGGGCTTTTATATACACTAGGAATTCTTGACGTGGGGTC<br>TCTGGAGCTCCAGGAAATTC<br>GGGCACATCATATGTCCATGAAACTTCAGATAAACTAGGGAAAACTGGGT<br>GCTGAGGTGAAAGCATAACT<br>TTTTTGGCACAGAAAGTCTAAAGGGGCCACTGATTTTCAAAGAGATCTGT<br>GATCCCTTTTTGTTTTTTGT<br>TTTTGAGATGGAGTCTTGCTCTGTTGCCCAGGCTGGAGTGCAATGGCACA<br>ATCTCGGCTCACTGCAAGCT<br>CCGCCTCCTGGGTTCAAGCGATTCTCCTGCCTCAGCCTCCTGAGTGGCTG<br>GGATTACAGGCATGCACCAC<br>CATGCCCAGCTAATTTGTTGTATTTTTAGTAGAGACAGGGTTTCACCATG<br>TTGGCCAGTGTGGTCTCAAA<br>CTCCTGACCTCATGATTTGCCTGCCTCGGCCTCCCAAAGCACTGGGATTA<br>CAGGCGTGAGCCACCACATC<br>CAGCCAGTGATCCTTAAAAGATTAAGAGATGACTGGACCAGGTCTACCTT<br>GATCTTGAAGATTCCCTTGG<br>AATGTTGAGATTTAGGCTTATTTGAGCACTGCCTGCCCAACTGTCAGTGC<br>CAGTGCATAGCCCTTCTTTT<br>GTCTCCCTTATGAAGACTGCCCTGCAGGGCTGAGATGTGGCAGGAGCTCC<br>CAGGGAAAAACGAAGTGCAT<br>TTGATTGGTGTGTATTGGCCAAGTTTTGCTTGTTGTGTGCTTGAAAGAAA<br>ATATCTCTGACCAACTTCTG<br>TATTCGTGGACCAAACTGAAGCTATATTTTTCACAGAAGAAGAAGCAGTG<br>ACGGGGACACAAATTCTGTT<br>GCCTGGTGGAAAGAAGGCAAAGGCCTTCAGCAATCTATATTACCAGCGCT<br>GGATCCTTTGACAGAGAGTG<br>GTCCCTAAACTTAAATTTCAAGACGGTATAGGCTTGATCTGTCTTGCTTA<br>TTGTTGCCCCCTGCGCCTAG<br>CACAATTCTGACACACAATTGGAACTTACTAAAAATTTTTTTTTACTGTT<br>AAAAAAAAAAAAAAAAAAA |
| 197 | | TIM3<br>Isoform 2<br>(nt) | ACTGCTCATGTGATTGTGGAGTAGACAGTTGGAAGAAGTACCCAGTCCAT<br>TTGGAGAGTTAAAACTGTGC<br>CTAACAGAGGTGTCCTCTGACTTTTCTTCTGCAAGCTCCATGTTTTCACA<br>TCTTCCCTTTGACTGTGTCC<br>TGCTGCTGCTGCTGCTACTACTTACAAGGTCCTCAGAAGTGGAATACAGA<br>GCGGAGGTCGGTCAGAATGC<br>CTATCTGCCCTGCTTCTACACCCCAGCCGCCCCAGGGAACCTCGTGCCCG<br>TCTGCTGGGGCAAAGGAGCC<br>TGTCCTGTGTTTGAATGTGGCAACGTGGTGCTCAGGACTGATGAAAGGGA<br>TGTGAATTATTGGACATCCA<br>GATACTGGCTAAATGGGGATTCCGCAAAGGAGATGTGTCCCTGACCATA<br>GAGAATGTGACTCTAGCAGA<br>CAGTGGGATCTACTGCTGCCGGATCCAAATCCCAGGCATAATGAATGATG<br>AAAAATTTAACCTGAAGTTG<br>GTCATCAAACCAGGTGAGTGGACATTTGCATGCCATCTTTATGAATAAGA<br>TTTATCTGTGGATCATATTA<br>AAGGTACTGATTGTTCTCATCTCTGACTTCCCTAATTATAGCCCTGGAGG<br>AGGGCCACTAAGACCTAAAG<br>TTTAACAGGCCCCATTGGTGATGCTCAGTGATATTTAACACCTTCTCTCT<br>GTTTTAAAACTCATGGGTGT<br>GCCTGGGCGTGGTGGCTCGCGCCTCTGGTCCCAGCACTTTGGGAGGCTGA<br>GGCCGGTGGATCATGAGGTC<br>AGGAATTCGAGACCAGCCTGGCCAACATGGTAAAACCTTGTCTCCACTAA<br>AAATACAAAAAATTAGCCAG<br>GCATGGTTACGGGAGCCTGTAATTCTAGCTACTTGGGGGGCTGAAGCAGG<br>AGAATCACTTGAACCTGGAA<br>GTCGGAGGTTGCGGTAAGCCAAGATCTCGCCATTGTACTCCAGCCTGGCT<br>GACAAGAGTGAAACTCTGTC<br>CCAAAAAAAAAAAAAAAAAAAAAAAAAAAA |
| 198 | | Extracellular<br>domain<br>of TIM3 | SEVEYRAEVGQNAYLPCFYTPAAPGNLVPVCWGKGACPVFECGNVVLRTD<br>ERDVNYWTSRYWLNGDFREGDVSLTIENVTLADSGITCCRIQIPGIMNDE<br>KFNLELVIKPAKVTPAPTRQRDETAAFPRMLTTRGHGPAETQTLGSLPDI<br>NLTQISTLANELRDSRLANDLRDSGATIRIG |

TABLE 8-continued

| SEQ ID | Antibody | Description | Sequences |
|---|---|---|---|
| 199 | | Cynomolgus TIM3 Protein | MFSHLPFDCVLLLLLLLLTRSSEVEYIAEVGQNAYLPCSYTPAPPGNLVP VCWGKGACPVFDCSNVVLRTENRDVNDRTSGRYWLKGDFHKGDVSLTIEN VTLADSGVYCCRIQIPGIMNDEKHNLKLVVIKPAKVTPAPTLQRDLTSAF PRMLTTGEHGPAETQTPGSLPDVNLTQIFTLTNELRDSGATIRTAIYIAA GISAGLALALIFGALIFKWYSHSKEKTQNLSLISLANIPPSGLANAVAEG IRSEENITTIEEDVYEVEEPNETYCYVSSGQQPSQPLGCRFAMP |
| 200 | | residues 37-43 of mature TIM3 ECD | CPVFECG |
| 201 | | residues 57-83 of mature TIM3 ECD | WTSRYWLNGDFR |
| 202 | | residues 90-99 of mature TIM3 ECD | RIQIPGIMND |
| 203 | | residues 1-99 of mature TIM3 ECD | SEVEYRAEVGQNAYLPCFYTPAAPGNLVPVCWGKGACPVFECGNVVLRTD ERDVNYWTSRYWLNGDFRKGDVSLTIENVTLADSGITCCRIQIPGIMND |
| 204 | | residues 49-62 of mature human TIM3 ECD | VPVCWGKGACPVFE |
| 205 | | residues 111-127 of mature human TIM3 ECD | RIQIPGIMNDEKENLKL |
| 206 | | residues 40-62 of mature human TIM3 ECD | YTPAAPGNLVPVCWGKGACPVFE |
| 207 | | residues 66-77 of mature human TIM3 ECD | VVLRTDERDVNY |
| 208 | | residues 78-95 of mature human TIM3 ECD | WTSRYWLNGDFRKGDVSL |
| 209 | | residues 110-127 of mature human TIM3 ECD | CRIQIPGIMNDEKENLKL |
| 210 | | residues 119-127 of mature human TIM3 ECD | NDEKENLKL |
| 211 | 13A3 | VH CDR1 degenerate | $X_1X_2X_3X_4YX_5X_6$ (numbers are subtypes) |
| 212 | 13A3 | VH CDR2 degenerate | $X_1IX_2X_3X_4GX_5X_6X_7X_8YX_9X_{10}X_{11}X_{12}X_{13}X_{14}$ (numbers are subtypes) |

TABLE 8-continued

| SEQ ID | Antibody | Description | Sequences |
|---|---|---|---|
| 213 | 13A3 | VH CDR3 degenerate | X1X2X3X4X5X6X7X8X9X10YGX11X12X13X14X15X16X17X18 (numbers are subtypes) |
| 214 | 13A3 | IgG1.1f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 215 | 8B9 | IgG1.1f HC | CAGGTGCAGCTGCAGGAGTCGGGCCCAGGACTGGTGAAGCCTTCGGAGAC<br>CCTGTCCCTCACCTGCACTGTCTCTGGTGGCTCCATCAGTCGTCACTACT<br>GGAACTGGATCCGGCAGCCCCCAGGGAAGGGACTGGAGTGGATTGGGTAT<br>ATCCATTACAGTGGAAGCACCAACTACAATTCCTCCCTCAAGAGTCGAGT<br>CACCATATCAGTAGACACGTCCAAGAACCAGTTCTCCCTGAAGCTGAGCT<br>CTGTGACCGCTGCGGACACGGCCGTGTATTACTGTGCGAGAGATACTGGG<br>TACTACGGTATGGACATCTGGGGCCAAGGGACCACGGTCACCGTCTCCTC<br>AGCTAGCACCAAGGGCCCATCGGTCTTCCCCCTGGCACCCTCCTCCAAGA<br>GCACCTCTGGGGGCACAGCGGCCCTGGGCTGCCTGGTCAAGGACTACTTC<br>CCCGAACCGGTGACGGTGTCGTGGAACTCAGGCGCCCTGACCAGCGGCGT<br>GCACACCTTCCCGGCTGTCCTACAGTCCTCAGGACTCTACTCCCTCAGCA<br>GCGTGGTGACCGTGCCCTCCAGCAGCTTGGGCACCCAGACCTACATCTGC<br>AACGTGAATCACAAGCCCAGCAACACCAAGGTGGACAAGAGAGTTGAGCC<br>CAAATCTTGTGACAAAACTCACACATGCCCACCGTGCCCAGCACCTGAAG<br>CCGAAGGGGCCCCGTCAGTCTTCCTCTTCCCCCCAAAACCCAAGGACACC<br>CTCATGATCTCCCGGACCCCTGAGGTCACATGCGTGGTGGTGGACGTGAG<br>CCACGAAGACCCTGAGGTCAAGTTCAACTGGTACGTGGACGGCGTGGAGG<br>TGCATAATGCCAAGACAAAGCCGCGGGAGGAGCAGTACAACAGCACGTAC<br>CGTGTGGTCAGCGTCCTCACCGTCCTGCACCAGGACTGGCTGAATGGCAA<br>GGAGTACAAGTGCAAGGTCTCCAACAAAGCCCTCCCAAGCAGCATCGAGA<br>AAACCATCTCCAAAGCCAAAGGGCAGCCCCGAGAACCACAGGTGTACACC<br>CTGCCCCCATCCCGGGAGGAGATGACCAAGAACCAGGTCAGCCTGACCTG<br>CCTGGTCAAAGGCTTCTATCCCAGCGACATCGCCGTGGAGTGGGAGAGCA<br>ATGGGCAGCCGGAGAACAACTACAAGACCACGCCTCCCGTGCTGGACTCC<br>GACGGCTCCTTCTTCCTCTATAGCAAGCTCACCGTGGACAAGAGCAGGTG<br>GCAGCAGGGGAACGTCTTCTCATGCTCCGTGATGCATGAGGCTCTGCACA<br>ACCACTACACGCAGAAGAGCCTCTCCCTGTCCCCGGGTAAATGA |
| 216 | 8C4 | IgG1.1f HC | CAGGTGCAGCTGCAGGAGTCGGGCCCAGGACTGGTGAAGCCTTCGGAGAC<br>CCTGTCCCTCACCTGCACTGTCTCTGGTGGCTCCATCAGTCGTTACTACT<br>GGAGCTGGATCCGGCAGCCCCCAGGGAAGGGACTGGAGTGGATTGGGTAT<br>ATCCATTACACTGGGAGCACCAACTACAACCCCTCCCTCAAGAGTCGAGT<br>CACCATATCAGTAGACACGTCCAAGAACCAGTTCTCCCTGAAGCTGAGCT<br>CTGTGACCGCAGCGGACACGGCCGTGTATTACTGTGCGACAGATACGGGC<br>TACTACGGTATGGACGTCTGGGGCCAAGGGACCACGGTCACCGTCTCCTC<br>AGCTAGCACCAAGGGCCCATCGGTCTTCCCCCTGGCACCCTCCTCCAAGA<br>GCACCTCTGGGGGCACAGCGGCCCTGGGCTGCCTGGTCAAGGACTACTTC<br>CCCGAACCGGTGACGGTGTCGTGGAACTCAGGCGCCCTGACCAGCGGCGT<br>GCACACCTTCCCGGCTGTCCTACAGTCCTCAGGACTCTACTCCCTCAGCA<br>GCGTGGTGACCGTGCCCTCCAGCAGCTTGGGCACCCAGACCTACATCTGC<br>AACGTGAATCACAAGCCCAGCAACACCAAGGTGGACAAGAGAGTTGAGCC<br>CAAATCTTGTGACAAAACTCACACATGCCCACCGTGCCCAGCACCTGAAG<br>CCGAAGGGGCCCCGTCAGTCTTCCTCTTCCCCCCAAAACCCAAGGACACC<br>CTCATGATCTCCCGGACCCCTGAGGTCACATGCGTGGTGGTGGACGTGAG |

TABLE 8-continued

| SEQ ID | Antibody | Description | Sequences |
|---|---|---|---|
| | | | CCACGAAGACCCTGAGGTCAAGTTCAACTGGTACGTGGACGGCGTGGAGG
TGCATAATGCCAAGACAAAGCCGCGGGAGGAGCAGTACAACAGCACGTAC
CGTGTGGTCAGCGTCCTCACCGTCCTGCACCAGGACTGGCTGAATGGCAA
GGAGTACAAGTGCAAGGTCTCCAACAAAGCCCTCCCAAGCAGCATCGAGA
AAACCATCTCCAAAGCCAAAGGGCAGCCCCGAGAACCACAGGTGTACACC
CTGCCCCCATCCCGGGAGGAGATGACCAAGAACCAGGTCAGCCTGACCTG
CCTGGTCAAAGGCTTCTATCCCAGCGACATCGCCGTGGAGTGGGAGAGCA
ATGGGCAGCCGGAGAACAACTACAAGACCACGCCTCCCGTGCTGGACTCC
GACGGCTCCTTCTTCCTCTATAGCAAGCTCACCGTGGACAAGAGCAGGTG
GCAGCAGGGGAACGTCTTCTCATGCTCCGTGATGCATGAGGCTCTGCACA
ACCACTACACGCAGAAGAGCCTCTCCCTGTCCCGGGTAAATGA |
| 217 | 17C3 | IgG1.1f HC | CAGGTGCAGTTGGTGCAGTCTGGGGCTGAGGTGAAGAAGCCTGGGGCCTC
AGTGAAGGTCTCCTGCAAGGCATCTGGATACACTTTCACCAGCTACTATA
TGCACTGGGTGCGACAGGCCCCTGGACAAGGGCTTGAGTGGATGGGAATA
ATCAACCCTAGGGGTGATAGCATAATCTACGCACAGAAGTTCCAGGGCAG
AGTCACCATGACCAGGGACACGTCCACGAGCACAGTCTACATGGAGCTGA
GCAGCCTGAGATCTGAGGACACGGCCGTGTATTACTGTGCGAGAGATTTC
TATGGTTCGGGAAACTACTACTACGGTATGGACGTCTGGGGCCAAGGGAC
CACGGTCACCGTCTCCTCAGCTAGCACCAAGGGCCCATCGGTCTTCCCCC
TGGCACCCTCCTCCAAGAGCACCTCTGGGGGCACAGCGGCCCTGGGCTGC
CTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGC
ACCCAGACCTACATCTGCAACGTGAATCACAAGCCCAGCAACACCAAGGT
GGACAAGAGAGTTGAGCCCAAATCTTGTGACAAAACTCACACATGCCCAC
CGTGCCCAGCACCTGAAGCCGAAGGGGCCCCGTCAGTCTTCCTCTTCCCC
CCAAAACCCAAGGACACCCTCATGATCTCCCGGACCCCTGAGGTCACATG
CGTGGTGGTGGACGTGAGCCACGAAGACCCTGAGGTCAAGTTCAACTGGT
ACGTGGACGGCGTGGAGGTGCATAATGCCAAGACAAAGCCGCGGGAGGAG
CAGTACAACAGCACGTACCGTGTGGTCAGCGTCCTCACCGTCCTGCACCA
GGACTGGCTGAATGGCAAGGAGTACAAGTGCAAGGTCTCCAACAAAGCCC
TCCCAAGCAGCATCGAGAAAACCATCTCCAAAGCCAAAGGGCAGCCCCGA
GAACCACAGGTGTACACCCTGCCCCCATCCCGGGAGGAGATGACCAAGAA
CCAGGTCAGCCTGACCTGCCTGGTCAAAGGCTTCTATCCCAGCGACATCG
CCGTGGAGTGGGAGAGCAATGGGCAGCCGGAGAACAACTACAAGACCACG
CCTCCCGTGCTGGACTCCGACGGCTCCTTCTTCCTCTATAGCAAGCTCAC
CGTGGACAAGAGCAGGTGGCAGCAGGGGAACGTCTTCTCATGCTCCGTGA
TGCATGAGGCTCTGCACAACCACTACACGCAGAAGAGCCTCTCCCTGTCC
CCGGGTAAATGA |
| 218 | 9F6 | IgG1.1f HC | CAGGTGCAGCTGGTGGAGTCTGGGGGAGGCTTGGTCAAGCCTGGAGGGTC
CCTGAGACTCTCCTGTGCAGCCTCTGGATTCACCTTCAGTGACTACTACA
TGAGCTGGATCCGCCAGGCTCCAGGGAAGGGGCTGGAGTGGGTTTCATTC
ATTAGTGGTGGTGGTAGTACCATATACTACGCAGACTCTGTGAAGGGCCG
ATTCACCATCTCCAGGGACAACGCCAAGAACTCGCTGTTTCTGCAAATGA
ACAGCCTGAGAGTCGAGGACACGGCTGTGTATTACTGTGCGAGAGATGGC
TATAGCAGTGGCTGGTACTACTACGGTATGGACGTCTGGGGCCAAGGGAC
CGCGGTCACCGTCTCCTCAGCTAGCACCAAGGGCCCATCGGTCTTCCCCC
TGGCACCCTCCTCCAAGAGCACCTCTGGGGGCACAGCGGCCCTGGGCTGC
CTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGC
ACCCAGACCTACATCTGCAACGTGAATCACAAGCCCAGCAACACCAAGGT
GGACAAGAGAGTTGAGCCCAAATCTTGTGACAAAACTCACACATGCCCAC
CGTGCCCAGCACCTGAAGCCGAAGGGGCCCCGTCAGTCTTCCTCTTCCCC
CCAAAACCCAAGGACACCCTCATGATCTCCCGGACCCCTGAGGTCACATG
CGTGGTGGTGGACGTGAGCCACGAAGACCCTGAGGTCAAGTTCAACTGGT
ACGTGGACGGCGTGGAGGTGCATAATGCCAAGACAAAGCCGCGGGAGGAG
CAGTACAACAGCACGTACCGTGTGGTCAGCGTCCTCACCGTCCTGCACCA
GGACTGGCTGAATGGCAAGGAGTACAAGTGCAAGGTCTCCAACAAAGCCC
TCCCAAGCAGCATCGAGAAAACCATCTCCAAAGCCAAAGGGCAGCCCCGA
GAACCACAGGTGTACACCCTGCCCCCATCCCGGGAGGAGATGACCAAGAA
CCAGGTCAGCCTGACCTGCCTGGTCAAAGGCTTCTATCCCAGCGACATCG
CCGTGGAGTGGGAGAGCAATGGGCAGCCGGAGAACAACTACAAGACCACG
CCTCCCGTGCTGGACTCCGACGGCTCCTTCTTCCTCTATAGCAAGCTCAC
CGTGGACAAGAGCAGGTGGCAGCAGGGGAACGTCTTCTCATGCTCCGTGA
TGCATGAGGCTCTGCACAACCACTACACGCAGAAGAGCCTCTCCCTGTCC
CCGGGTAAATGA |
| 219 | 3G4 | IgG1.1f HC | CAGGTGCAGCTGGTGGAGTCTGGGGGAGGCTTGGTCAAGCCTGGAGGGTC
CCTGAGACTCTCCTGTGCAGCCTCTGGATTCACCTTCAGTGACTACTACA
TGAGCTGGATCCGCCAGGCTCCAGGGAAGGGGCTGGAGTGGGTTTCATTC
ATTAGTACTAGTGGTAGTATCATATACTACGCAGACTCTGTGAAGGGCCG
ATTCACCATCTCCAGGGACAACGCCAAGAACTCACTGTATCTGCAAATGA
ACAGCCTGAGAGCCGAGGACACGGCTGTGTATTACTGTGCGAGAGAAGGG
TATAGCAGCAGCTGGTCCTACTACTACGGTATGGACGTCTGGGGCCAAGG |

TABLE 8-continued

| SEQ ID | Antibody | Description | Sequences |
|---|---|---|---|
| | | | GACCACGGTCACCGTCTCCTCAGCTAGCACCAAGGGCCCATCGGTCTTCC<br>CCCTGGCACCCTCCTCCAAGAGCACCTCTGGGGGCACAGCGGCCCTGGGC<br>TGCCTGGTCAAGGACTACTTCCCCGAACCGGTGACGGTGTCGTGGAACTC<br>AGGCGCCCTGACCAGCGGCGTGCACACCTTCCCGGCTGTCCTACAGTCCT<br>CAGGACTCTACTCCCTCAGCAGCGTGGTGACCGTGCCCTCCAGCAGCTTG<br>GGCACCCAGACCTACATCTGCAACGTGAATCACAAGCCCAGCAACACCAA<br>GGTGGACAAGAGAGTTGAGCCCAAATCTTGTGACAAAACTCACACATGCC<br>CACCGTGCCCAGCACCTGAAGCCGAAGGGGCCCCGTCAGTCTTCCTCTTC<br>CCCCCAAAACCCAAGGACACCCTCATGATCTCCCGGACCCCTGAGGTCAC<br>ATGCGTGGTGGTGGACGTGAGCCACGAAGACCCTGAGGTCAAGTTCAACT<br>GGTACGTGGACGGCGTGGAGGTGCATAATGCCAAGACAAAGCCGCGGGAG<br>GAGCAGTACAACAGCACGTACCGTGTGGTCAGCGTCCTCACCGTCCTGCA<br>CCAGGACTGGCTGAATGGCAAGGAGTACAAGTGCAAGGTCTCCAACAAAG<br>CCCTCCCAAGCAGCATCGAGAAAACCATCTCCAAAGCCAAAGGGCAGCCC<br>CGAGAACCACAGGTGTACACCCTGCCCCCATCCCGGGAGGAGATGACCAA<br>GAACCAGGTCAGCCTGACCTGCCTGGTCAAAGGCTTCTATCCCAGCGACA<br>TCGCCGTGGAGTGGGAGAGCAATGGGCAGCCGGAGAACAACTACAAGACC<br>ACGCCTCCCGTGCTGGACTCCGACGGCTCCTTCTTCCTCTATAGCAAGCT<br>CACCGTGGACAAGAGCAGGTGGCAGCAGGGGAACGTCTTCTCATGCTCCG<br>TGATGCATGAGGCTCTGCACAACCACTACACGCAGAAGAGCCTCTCCCTG<br>TCCCCGGGTAAATGA |
| 220 | 17C8 | IgG1.1f HC | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTAGTAGTGGTAGTATCATATACTACGCAGACTCTGTGAAGGGCCG<br>ATTCACCATCTCCAGGGACAACGCCAAGAACTCACTGTATCTGCAAATGA<br>ACAGCCTGAGAGCCGAGGACACGGCTGTGTATTACTGTGCGAGAGATGGG<br>TATAGCAGTGGCTGGGAGTACTACGGTATGGACGTCTGGGGCCAAGGGAC<br>CACGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 221 | 13A3 | IgG1.1f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA |

TABLE 8-continued

| SEQ ID | Antibody | Description | Sequences |
|---|---|---|---|
| | | | TGCATGAGGCTCTGCACAACCACTACACGCAGAAGAGCCTCTCCCTGTCC CCGGGTTGA |
| 222 | 8B9 | IgG1.1g HC (no C-terminal K) | CAGGTGCAGCTGCAGGAGTCGGGCCCAGGACTGGTGAAGCCTTCGGAGAC CCTGTCCCTCACCTGCACTGTCTCTGGTGGCTCCATCAGTCGTCACTACT GGAACTGGATCCGGCAGCCCCCAGGGAAGGGACTGGAGTGGATTGGGTAT ATCCATTACAGTGGAAGCACCAACTACAATTCCTCCCTCAAGAGTCGAGT CACCATATCAGTAGACACGTCCAAGAACCAGTTCTCCCTGAAGCTGAGCT CTGTGACCGCTGCGGACACGGCCGTGTATTACTGTGCGAGAGATACTGGG TACTACGGTATGGACATCTGGGGCCAAGGGACCACGGTCACCGTCTCCTC AGCTAGCACCAAGGGCCCATCGGTCTTCCCCCTGGCACCCTCCTCCAAGA GCACCTCTGGGGGCACAGCGGCCCTGGGCTGCCTGGTCAAGGACTACTTC CCCGAACCGGTGACGGTGTCGTGGAACTCAGGCGCCCTGACCAGCGGCGT GCACACCTTCCCGGCTGTCCTACAGTCCTCAGGACTCTACTCCCTCAGCA GCGTGGTGACCGTGCCCTCCAGCAGCTTGGGCACCCAGACCTACATCTGC AACGTGAATCACAAGCCCAGCAACACCAAGGTGGACAAGAGAGTTGAGCC CAAATCTTGTGACAAAACTCACACATGCCCACCGTGCCCAGCACCTGAAG CCGAAGGGGCCCGTCAGTCTTCCTCTTCCCCCCAAAACCCAAGGACACC CTCATGATCTCCCGGACCCCTGAGGTCACATGCGTGGTGGTGGACGTGAG CCACGAAGACCCTGAGGTCAAGTTCAACTGGTACGTGGACGGCGTGGAGG TGCATAATGCCAAGACAAAGCCGCGGGAGGAGCAGTACAACAGCACGTAC CGTGTGGTCAGCGTCCTCACCGTCCTGCACCAGGACTGGCTGAATGGCAA GGAGTACAAGTGCAAGGTCTCCAACAAAGCCCTCCCAAGCAGCATCGAGA AAACCATCTCCAAAGCCAAAGGGCAGCCCCGAGAACCACAGGTGTACACC CTGCCCCCATCCCGGGAGGAGATGACCAAGAACCAGGTCAGCCTGACCTG CCTGGTCAAAGGCTTCTATCCCAGCGACATCGCCGTGGAGTGGGAGAGCA ATGGGCAGCCGGAGAACAACTACAAGACCACGCCTCCCGTGCTGGACTCC GACGGCTCCTTCTTCCTCTATAGCAAGCTCACCGTGGACAAGAGCAGGTG GCAGCAGGGGAACGTCTTCTCATGCTCCGTGATGCATGAGGCTCTGCACA ACCACTACACGCAGAAGAGCCTCTCCCTGTCCCCGGGTTGA |
| 223 | 8C4 | IgG1.1f HC (no C-terminal K) | CAGGTGCAGCTGCAGGAGTCGGGCCCAGGACTGGTGAAGCCTTCGGAGAC CCTGTCCCTCACCTGCACTGTCTCTGGTGGCTCCATCAGTCGTTACTACT GGAGCTGGATCCGGCAGCCCCCAGGGAAGGGACTGGAGTGGATTGGGTAT ATCCATTACACTGGGAGCACCAACTACAACCCCTCCCTCAAGAGTCGAGT CACCATATCAGTAGACACGTCCAAGAACCAGTTCTCCCTGAAGCTGAGCT CTGTGACCGCAGCGGACACGGCCGTGTATTACTGTGCGACAGATACGGGC TACTACGGTATGGACGTCTGGGGCCAAGGGACCACGGTCACCGTCTCCTC AGCTAGCACCAAGGGCCCATCGGTCTTCCCCCTGGCACCCTCCTCCAAGA GCACCTCTGGGGGCACAGCGGCCCTGGGCTGCCTGGTCAAGGACTACTTC CCCGAACCGGTGACGGTGTCGTGGAACTCAGGCGCCCTGACCAGCGGCGT GCACACCTTCCCGGCTGTCCTACAGTCCTCAGGACTCTACTCCCTCAGCA GCGTGGTGACCGTGCCCTCCAGCAGCTTGGGCACCCAGACCTACATCTGC AACGTGAATCACAAGCCCAGCAACACCAAGGTGGACAAGAGAGTTGAGCC CAAATCTTGTGACAAAACTCACACATGCCCACCGTGCCCAGCACCTGAAG CCGAAGGGGCCCGTCAGTCTTCCTCTTCCCCCCAAAACCCAAGGACACC CTCATGATCTCCCGGACCCCTGAGGTCACATGCGTGGTGGTGGACGTGAG CCACGAAGACCCTGAGGTCAAGTTCAACTGGTACGTGGACGGCGTGGAGG TGCATAATGCCAAGACAAAGCCGCGGGAGGAGCAGTACAACAGCACGTAC CGTGTGGTCAGCGTCCTCACCGTCCTGCACCAGGACTGGCTGAATGGCAA GGAGTACAAGTGCAAGGTCTCCAACAAAGCCCTCCCAAGCAGCATCGAGA AAACCATCTCCAAAGCCAAAGGGCAGCCCCGAGAACCACAGGTGTACACC CTGCCCCCATCCCGGGAGGAGATGACCAAGAACCAGGTCAGCCTGACCTG CCTGGTCAAAGGCTTCTATCCCAGCGACATCGCCGTGGAGTGGGAGAGCA ATGGGCAGCCGGAGAACAACTACAAGACCACGCCTCCCGTGCTGGACTCC GACGGCTCCTTCTTCCTCTATAGCAAGCTCACCGTGGACAAGAGCAGGTG GCAGCAGGGGAACGTCTTCTCATGCTCCGTGATGCATGAGGCTCTGCACA ACCACTACACGCAGAAGAGCCTCTCCCTGTCCCCGGGTTGA |
| 224 | 17C3 | IgG1.1f HC (no C-terminal K) | CAGGTGCAGTTGGTGCAGTCTGGGGCTGAGGTGAAGAAGCCTGGGGCCTC AGTGAAGGTCTCCTGCAAGGCATCTGGATACACTTTCACCAGCTACTATA TGCACTGGGTGCGACAGGCCCCTGGACAAGGGCTTGAGTGGATGGGAATA ATCAACCCTAGGGGTGATAGCATAATCTACGCACAGAAGTTCCAGGGCAG AGTCACCATGACCAGGGACACGTCCACGAGCACAGTCTACATGGAGCTGA GCAGCCTGAGATCTGAGGACACGGCCGTGTATTACTGTGCGAGAGATTTC TATGGTTCGGGAAACTACTACTACGGTATGGACGTCTGGGGCCAAGGGAC CACGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCGTCAGTCTTCCTCTTCCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG |

TABLE 8-continued

| SEQ ID | Antibody | Description | Sequences |
|---|---|---|---|
| | | | CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTTGA |
| 225 | 9F6 | IgG1.1f HC (no C-terminal K) | CAGGTGCAGCTGGTGGAGTCTGGGGGAGGCTTGGTCAAGCCTGGAGGGTC CCTGAGACTCTCCTGTGCAGCCTCTGGATTCACCTTCAGTGACTACTACA TGAGCTGGATCCGCCAGGCTCCAGGGAAGGGGCTGGAGTGGGTTTCATTC ATTAGTGGTGGTGGTAGTACCATATACTACGCAGACTCTGTGAAGGGCCG ATTCACCATCTCCAGGGACAACGCCAAGAACTCGCTGTTTCTGCAAATGA ACAGCCTGAGAGTCGAGGACACGGCTGTGTATTACTGTGCGAGAGATGGC TATAGCAGTGGCTGGTACTACTACGGTATGGACGTCTGGGGCCAAGGGAC CGCGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTTGA |
| 226 | 3G4 | IgG1.1f HC (no C-terminal K) | CAGGTGCAGCTGGTGGAGTCTGGGGGAGGCTTGGTCAAGCCTGGAGGGTC CCTGAGACTCTCCTGTGCAGCCTCTGGATTCACCTTCAGTGACTACTACA TGAGCTGGATCCGCCAGGCTCCAGGGAAGGGGCTGGAGTGGGTTTCATTC ATTAGTACTAGTGGTAGTATCATATACTACGCAGACTCTGTGAAGGGCCG ATTCACCATCTCCAGGGACAACGCCAAGAACTCACTGTATCTGCAAATGA ACAGCCTGAGAGCCGAGGACACGGCTGTGTATTACTGTGCGAGAGAAGGG TATAGCAGCAGCTGGTCCTACTACTACGGTATGGACGTCTGGGGCCAAGG GACCACGGTCACCGTCTCCTCAGCTAGCACCAAGGGCCCATCGGTCTTCC CCCTGGCACCCTCCTCCAAGAGCACCTCTGGGGGCACAGCGGCCCTGGGC TGCCTGGTCAAGGACTACTTCCCCGAACCGGTGACGGTGTCGTGGAACTC AGGCGCCCTGACCAGCGGCGTGCACACCTTCCCGGCTGTCCTACAGTCCT CAGGACTCTACTCCCTCAGCAGCGTGGTGACCGTGCCCTCCAGCAGCTTG GGCACCCAGACCTACATCTGCAACGTGAATCACAAGCCCAGCAACACCAA GGTGGACAAGAGAGTTGAGCCCAAATCTTGTGACAAAACTCACACATGCC CACCGTGCCCAGCACCTGAAGCCGAAGGGGCCCCGTCAGTCTTCCTCTTC CCCCCAAAACCCAAGGACACCCTCATGATCTCCCGGACCCCTGAGGTCAC ATGCGTGGTGGTGGACGTGAGCCACGAAGACCCTGAGGTCAAGTTCAACT GGTACGTGGACGGCGTGGAGGTGCATAATGCCAAGACAAAGCCGCGGGAG GAGCAGTACAACAGCACGTACCGTGTGGTCAGCGTCCTCACCGTCCTGCA CCAGGACTGGCTGAATGGCAAGGAGTACAAGTGCAAGGTCTCCAACAAAG CCCTCCCAAGCAGCATCGAGAAAACCATCTCCAAAGCCAAAGGGCAGCCC CGAGAACCACAGGTGTACACCCTGCCCCCATCCCGGGAGGAGATGACCAA GAACCAGGTCAGCCTGACCTGCCTGGTCAAAGGCTTCTATCCCAGCGACA TCGCCGTGGAGTGGGAGAGCAATGGGCAGCCGGAGAACAACTACAAGACC ACGCCTCCCGTGCTGGACTCCGACGGCTCCTTCTTCCTCTATAGCAAGCT CACCGTGGACAAGAGCAGGTGGCAGCAGGGGAACGTCTTCTCATGCTCCG TGATGCATGAGGCTCTGCACAACCACTACACGCAGAAGAGCCTCTCCCTG TCCCCGGGTTGA |
| 227 | 17C8 | IgG1.1f HC (no C-terminal K) | CAGGTGCAGCTGGTGGAGTCTGGGGGAGGCTTGGTCAAGCCTGGAGGGTC CCTGAGACTCTCCTGTGCAGCCTCTGGATTCACCTTCAGTGACTACTACA TGAGCTGGATCCGCCAGGCTCCAGGGAAGGGGCTGGAGTGGGTTTCATTC ATTAGTAGTAGTGGTAGTATCATATACTACGCAGACTCTGTGAAGGGCCG ATTCACCATCTCCAGGGACAACGCCAAGAACTCACTGTATCTGCAAATGA ACAGCCTGAGAGCCGAGGACACGGCTGTGTATTACTGTGCGAGAGATGGG TATAGCAGTGGCTGGGAGTACTACGGTATGGACGTCTGGGGCCAAGGGAC CACGGTCACCGTCTCCTCAGCTAGCACCAAGGGCCCATCGGTCTTCCCCC |

TABLE 8-continued

| SEQ ID | Antibody | Description | Sequences |
|---|---|---|---|
| | | | TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTTGA |
| 228 | 13A3 | IgG1.3f HC | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCCAGGGAAGGGGCTGGAGTGGATT GGGAGTATCTATTATAGTGGGTTCACCTACTACAACCCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACCCCTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAGCCCCCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 229 | 8B9 | IgG1.3f HC | AGGTGCAGCTGCAGGAGTCGGGCCCAGGACTGGTGAAGCCTTCGGAGACC CTGTCCCTCACCTGCACTGTCTCTGGTGGCTCCATCAGTCGTCACTACTG GAACTGGATCCGGCAGCCCCCAGGGAAGGGACTGGAGTGGATTGGGTATA TCCATTACAGTGGAAGCACCAACTACAATTCCTCCCTCAAGAGTCGAGTC ACCATATCAGTAGACACGTCCAAGAACCAGTTCTCCCTGAAGCTGAGCTC TGTGACCGCTGCGGACACGGCCGTGTATTACTGTGCGAGAGATACTGGGT ACTACGGTATGGACATCTGGGGCCAAGGGACCACGGTCACCGTCTCCTCA GCTAGCACCAAGGGCCCATCGGTCTTCCCCCTGGCACCCTCCTCCAAGAG CACCTCTGGGGGCACAGCGGCCCTGGGCTGCCTGGTCAAGGACTACTTCC CCGAACCGGTGACGGTGTCGTGGAACTCAGGCGCCCTGACCAGCGGCGTG CACACCTTCCCGGCTGTCCTACAGTCCTCAGGACTCTACTCCCTCAGCAG CGTGGTGACCGTGCCCTCCAGCAGCTTGGGCACCCAGACCTACATCTGCA ACGTGAATCACAAGCCCAGCAACACCAAGGTGGACAAGAGAGTTGAGCCC AAATCTTGTGACAAAACTCACACATGCCCACCGTGCCCAGCACCTGAAGC CGAAGGGGCCCCGTCAGTCTTCCTCTTCCCCCCAAAACCCAAGGACACCC TCATGATCTCCCGGACCCCTGAGGTCACATGCGTGGTGGTGGACGTGAGC CACGAAGACCCTGAGGTCAAGTTCAACTGGTACGTGGACGGCGTGGAGGT GCATAATGCCAAGACAAAGCCGCGGGAGGAGCAGTACAACAGCACGTACC GTGTGGTCAGCGTCCTCACCGTCCTGCACCAGGACTGGCTGAATGGCAAG GAGTACAAGTGCAAGGTCTCCAACAAAGCCCTCCCAGCCCCCATCGAGAA AACCATCTCCAAAGCCAAAGGGCAGCCCCGAGAACCACAGGTGTACACCC TGCCCCCATCCCGGGAGGAGATGACCAAGAACCAGGTCAGCCTGACCTGC CTGGTCAAAGGCTTCTATCCCAGCGACATCGCCGTGGAGTGGGAGAGCAA TGGGCAGCCGGAGAACAACTACAAGACCACGCCTCCCGTGCTGGACTCCG ACGGCTCCTTCTTCCTCTATAGCAAGCTCACCGTGGACAAGAGCAGGTGG CAGCAGGGGAACGTCTTCTCATGCTCCGTGATGCATGAGGCTCTGCACAA CCACTACACGCAGAAGAGCCTCTCCCTGTCCCCGGGTAAATGA |

TABLE 8-continued

| SEQ ID | Antibody | Description | Sequences |
|---|---|---|---|
| 230 | 8C4 | IgG1.3f HC | CAGGTGCAGCTGCAGGAGTCGGGCCCAGGACTGGTGAAGCCTTCGGAGAC<br>CCTGTCCCTCACCTGCACTGTCTCTGGTGGCTCCATCAGTCGTTACTACT<br>GGAGCTGGATCCGGCAGCCCCCAGGGAAGGGACTGGAGTGGATTGGGTAT<br>ATCCATTACACTGGGAGCACCAACTACAACCCCTCCCTCAAGAGTCGAGT<br>CACCATATCAGTAGACACGTCCAAGAACCAGTTCTCCCTGAAGCTGAGCT<br>CTGTGACCGCAGCGGACACGGCCGTGTATTACTGTGCGACAGATACGGGC<br>TACTACGGTATGGACGTCTGGGGCCAAGGGACCACGGTCACCGTCTCCTC<br>AGCTAGCACCAAGGGCCCATCGGTCTTCCCCCTGGCACCCTCCTCCAAGA<br>GCACCTCTGGGGGCACAGCGGCCCTGGGCTGCCTGGTCAAGGACTACTTC<br>CCCGAACCGGTGACGGTGTCGTGGAACTCAGGCGCCCTGACCAGCGGCGT<br>GCACACCTTCCCGGCTGTCCTACAGTCCTCAGGACTCTACTCCCTCAGCA<br>GCGTGGTGACCGTGCCCTCCAGCAGCTTGGGCACCCAGACCTACATCTGC<br>AACGTGAATCACAAGCCCAGCAACACCAAGGTGGACAAGAGAGTTGAGCC<br>CAAATCTTGTGACAAAACTCACACATGCCCACCGTGCCCAGCACCTGAAG<br>CCGAAGGGGCCCCGTCAGTCTTCCTCTTCCCCCCAAAACCCAAGGACACC<br>CTCATGATCTCCCGGACCCCTGAGGTCACATGCGTGGTGGTGGACGTGAG<br>CCACGAAGACCCTGAGGTCAAGTTCAACTGGTACGTGGACGGCGTGGAGG<br>TGCATAATGCCAAGACAAAGCCGCGGGAGGAGCAGTACAACAGCACGTAC<br>CGTGTGGTCAGCGTCCTCACCGTCCTGCACCAGGACTGGCTGAATGGCAA<br>GGAGTACAAGTGCAAGGTCTCCAACAAAGCCCTCCCAGCCCCCATCGAGA<br>AAACCATCTCCAAAGCCAAAGGGCAGCCCCGAGAACCACAGGTGTACACC<br>CTGCCCCCATCCCGGGAGGAGATGACCAAGAACCAGGTCAGCCTGACCTG<br>CCTGGTCAAAGGCTTCTATCCCAGCGACATCGCCGTGGAGTGGGAGAGCA<br>ATGGGCAGCCGGAGAACAACTACAAGACCACGCCTCCCGTGCTGGACTCC<br>GACGGCTCCTTCTTCCTCTATAGCAAGCTCACCGTGGACAAGAGCAGGTG<br>GCAGCAGGGGAACGTCTTCTCATGCTCCGTGATGCATGAGGCTCTGCACA<br>ACCACTACACGCAGAAGAGCCTCTCCCTGTCCCCGGGTAAATGA |
| 231 | 17C3 | IgG1.3f HC | CAGGTGCAGTTGGTGCAGTCTGGGGCTGAGGTGAAGAAGCCTGGGGCCTC<br>AGTGAAGGTCTCCTGCAAGGCATCTGGATACACTTTCACCAGCTACTATA<br>TGCACTGGGTGCGACAGGCCCCTGGACAAGGGCTTGAGTGGATGGGAATA<br>ATCAACCCTAGGGGTGATAGCATAATCTACGCACAGAAGTTCCAGGGCAG<br>AGTCACCATGACCAGGGACACGTCCACGAGCACAGTCTACATGGAGCTGA<br>GCAGCCTGAGATCTGAGGACACGGCCGTGTATTACTGTGCGAGAGATTTC<br>TATGGTTCGGGAAACTACTACTACGGTATGGACGTCTGGGGCCAAGGGAC<br>CACGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 232 | 9F6 | IgG1.3f HC | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTGGTGGTGGTAGTACCATATACTACGCAGACTCTGTGAAGGGCCG<br>ATTCACCATCTCCAGGGACAACGCCAAGAACTCGCTGTTTCTGCAAATGA<br>ACAGCCTGAGAGTCGAGGACACGGCTGTGTATTACTGTGCGAGAGATGGC<br>TATAGCAGTGGCTGGTACTACTACGGTATGGACGTCTGGGGCCAAGGGAC<br>CGCGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA |

TABLE 8-continued

| SEQ ID | Antibody | Description | Sequences |
|---|---|---|---|
| | | | GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 233 | 3G4 | IgG1.3f HC | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTACTAGTGGTAGTATCATATACTACGCAGACTCTGTGAAGGGCCG<br>ATTCACCATCTCCAGGGACAACGCCAAGAACTCACTGTATCTGCAAATGA<br>ACAGCCTGAGAGCCGAGGACACGGCTGTGTATTACTGTGCGAGAGAAGGG<br>TATAGCAGCAGCTGGTCCTACTACTACGGTATGGACGTCTGGGGCCAAGG<br>GACCACGGTCACCGTCTCCTCAGCTAGCACCAAGGGCCCATCGGTCTTCC<br>CCCTGGCACCCTCCTCCAAGAGCACCTCTGGGGGCACAGCGGCCCTGGGC<br>TGCCTGGTCAAGGACTACTTCCCCGAACCGGTGACGGTGTCGTGGAACTC<br>AGGCGCCCTGACCAGCGGCGTGCACACCTTCCCGGCTGTCCTACAGTCCT<br>CAGGACTCTACTCCCTCAGCAGCGTGGTGACCGTGCCCTCCAGCAGCTTG<br>GGCACCCAGACCTACATCTGCAACGTGAATCACAAGCCCAGCAACACCAA<br>GGTGGACAAGAGAGTTGAGCCCAAATCTTGTGACAAAACTCACACATGCC<br>CACCGTGCCCAGCACCTGAAGCCGAAGGGGCCCCGTCAGTCTTCCTCTTC<br>CCCCCAAAACCCAAGGACACCCTCATGATCTCCCGGACCCCTGAGGTCAC<br>ATGCGTGGTGGTGGACGTGAGCCACGAAGACCCTGAGGTCAAGTTCAACT<br>GGTACGTGGACGGCGTGGAGGTGCATAATGCCAAGACAAAGCCGCGGGAG<br>GAGCAGTACAACAGCACGTACCGTGTGGTCAGCGTCCTCACCGTCCTGCA<br>CCAGGACTGGCTGAATGGCAAGGAGTACAAGTGCAAGGTCTCCAACAAAG<br>CCCTCCCAGCCCCCATCGAGAAAACCATCTCCAAAGCCAAAGGGCAGCCC<br>CGAGAACCACAGGTGTACACCCTGCCCCCATCCCGGGAGGAGATGACCAA<br>GAACCAGGTCAGCCTGACCTGCCTGGTCAAAGGCTTCTATCCCAGCGACA<br>TCGCCGTGGAGTGGGAGAGCAATGGGCAGCCGGAGAACAACTACAAGACC<br>ACGCCTCCCGTGCTGGACTCCGACGGCTCCTTCTTCCTCTATAGCAAGCT<br>CACCGTGGACAAGAGCAGGTGGCAGCAGGGGAACGTCTTCTCATGCTCCG<br>TGATGCATGAGGCTCTGCACAACCACTACACGCAGAAGAGCCTCTCCCTG<br>TCCCCGGGTAAATGA |
| 234 | 17C8 | IgG1.3f HC | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTAGTAGTGGTAGTATCATATACTACGCAGACTCTGTGAAGGGCCG<br>ATTCACCATCTCCAGGGACAACGCCAAGAACTCACTGTATCTGCAAATGA<br>ACAGCCTGAGAGCCGAGGACACGGCTGTGTATTACTGTGCGAGAGATGGG<br>TATAGCAGTGGCTGGGAGTACTACGGTATGGACGTCTGGGGCCAAGGGAC<br>CACGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 235 | 13A3 | IgG1.3f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC |

TABLE 8-continued

| SEQ ID | Antibody | Description | Sequences |
|---|---|---|---|
| | | | CTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGC
ACCCAGACCTACATCTGCAACGTGAATCACAAGCCCAGCAACACCAAGGT
GGACAAGAGAGTTGAGCCCAAATCTTGTGACAAAACTCACACATGCCCAC
CGTGCCCAGCACCTGAAGCCGAAGGGGCCCCGTCAGTCTTCCTCTTCCCC
CCAAAACCCAAGGACACCCTCATGATCTCCCGGACCCCTGAGGTCACATG
CGTGGTGGTGGACGTGAGCCACGAAGACCCTGAGGTCAAGTTCAACTGGT
ACGTGGACGGCGTGGAGGTGCATAATGCCAAGACAAAGCCGCGGGAGGAG
CAGTACAACAGCACGTACCGTGTGGTCAGCGTCCTCACCGTCCTGCACCA
GGACTGGCTGAATGGCAAGGAGTACAAGTGCAAGGTCTCCAACAAAGCCC
TCCCAGCCCCCATCGAGAAAACCATCTCCAAAGCCAAAGGGCAGCCCCGA
GAACCACAGGTGTACACCCTGCCCCCATCCCGGGAGGAGATGACCAAGAA
CCAGGTCAGCCTGACCTGCCTGGTCAAAGGCTTCTATCCCAGCGACATCG
CCGTGGAGTGGGAGAGCAATGGGCAGCCGGAGAACAACTACAAGACCACG
CCTCCCGTGCTGGACTCCGACGGCTCCTTCTTCCTCTATAGCAAGCTCAC
CGTGGACAAGAGCAGGTGGCAGCAGGGGAACGTCTTCTCATGCTCCGTGA
TGCATGAGGCTCTGCACAACCACTACACGCAGAAGAGCCTCTCCCTGTCC
CCGGGTTGA |
| 236 | 8B9 | IgG1.3f HC (no C-terminal K) | AGGTGCAGCTGCAGGAGTCGGGCCCAGGACTGGTGAAGCCTTCGGAGACC
CTGTCCCTCACCTGCACTGTCTCTGGTGGCTCCATCAGTCGTCACTACTG
GAACTGGATCCGGCAGCCCCCAGGGAAGGGACTGGAGTGGATTGGGTATA
TCCATTACAGTGGAAGCACCAACTACAATTCCTCCCTCAAGAGTCGAGTC
ACCATATCAGTAGACACGTCCAAGAACCAGTTCTCCCTGAAGCTGAGCTC
TGTGACCGCTGCGGACACGGCCGTGTATTACTGTGCGAGAGATACTGGGT
ACTACGGTATGGACATCTGGGGCCAAGGGACCACGGTCACCGTCTCCTCA
GCTAGCACCAAGGGCCCATCGGTCTTCCCCCTGGCACCCTCCTCCAAGAG
CACCTCTGGGGGCACAGCGGCCCTGGGCTGCCTGGTCAAGGACTACTTCC
CCGAACCGGTGACGGTGTCGTGGAACTCAGGCGCCCTGACCAGCGGCGTG
CACACCTTCCCGGCTGTCCTACAGTCCTCAGGACTCTACTCCCTCAGCAG
CGTGGTGACCGTGCCCTCCAGCAGCTTGGGCACCCAGACCTACATCTGCA
ACGTGAATCACAAGCCCAGCAACACCAAGGTGGACAAGAGAGTTGAGCCC
AAATCTTGTGACAAAACTCACACATGCCCACCGTGCCCAGCACCTGAAGC
CGAAGGGGCCCCGTCAGTCTTCCTCTTCCCCCCAAAACCCAAGGACACCC
TCATGATCTCCCGGACCCCTGAGGTCACATGCGTGGTGGTGGACGTGAGC
CACGAAGACCCTGAGGTCAAGTTCAACTGGTACGTGGACGGCGTGGAGGT
GCATAATGCCAAGACAAAGCCGCGGGAGGAGCAGTACAACAGCACGTACC
GTGTGGTCAGCGTCCTCACCGTCCTGCACCAGGACTGGCTGAATGGCAAG
GAGTACAAGTGCAAGGTCTCCAACAAAGCCCTCCCAGCCCCCATCGAGAA
AACCATCTCCAAAGCCAAAGGGCAGCCCCGAGAACCACAGGTGTACACCC
TGCCCCCATCCCGGGAGGAGATGACCAAGAACCAGGTCAGCCTGACCTGC
CTGGTCAAAGGCTTCTATCCCAGCGACATCGCCGTGGAGTGGGAGAGCAA
TGGGCAGCCGGAGAACAACTACAAGACCACGCCTCCCGTGCTGGACTCCG
ACGGCTCCTTCTTCCTCTATAGCAAGCTCACCGTGGACAAGAGCAGGTGG
CAGCAGGGGAACGTCTTCTCATGCTCCGTGATGCATGAGGCTCTGCACAA
CCACTACACGCAGAAGAGCCTCTCCCTGTCCCCGGGTTGA |
| 237 | 8C4 | IgG1.3f HC (no C-terminal K) | CAGGTGCAGCTGCAGGAGTCGGGCCCAGGACTGGTGAAGCCTTCGGAGAC
CCTGTCCCTCACCTGCACTGTCTCTGGTGGCTCCATCAGTCGTTACTACT
GGAGCTGGATCCGGCAGCCCCCAGGGAAGGGACTGGAGTGGATTGGGTAT
ATCCATTACACTGGGAGCACCAACTACAACCCCTCCCTCAAGAGTCGAGT
CACCATATCAGTAGACACGTCCAAGAACCAGTTCTCCCTGAAGCTGAGCT
CTGTGACCGCAGCGGACACGGCCGTGTATTACTGTGCGACAGATACGGGC
TACTACGGTATGGACGTCTGGGGCCAAGGGACCACGGTCACCGTCTCCTC
AGCTAGCACCAAGGGCCCATCGGTCTTCCCCCTGGCACCCTCCTCCAAGA
GCACCTCTGGGGGCACAGCGGCCCTGGGCTGCCTGGTCAAGGACTACTTC
CCCGAACCGGTGACGGTGTCGTGGAACTCAGGCGCCCTGACCAGCGGCGT
GCACACCTTCCCGGCTGTCCTACAGTCCTCAGGACTCTACTCCCTCAGCA
GCGTGGTGACCGTGCCCTCCAGCAGCTTGGGCACCCAGACCTACATCTGC
AACGTGAATCACAAGCCCAGCAACACCAAGGTGGACAAGAGAGTTGAGCC
CAAATCTTGTGACAAAACTCACACATGCCCACCGTGCCCAGCACCTGAAG
CCGAAGGGGCCCCGTCAGTCTTCCTCTTCCCCCCAAAACCCAAGGACACC
CTCATGATCTCCCGGACCCCTGAGGTCACATGCGTGGTGGTGGACGTGAG
CCACGAAGACCCTGAGGTCAAGTTCAACTGGTACGTGGACGGCGTGGAGG
TGCATAATGCCAAGACAAAGCCGCGGGAGGAGCAGTACAACAGCACGTAC
CGTGTGGTCAGCGTCCTCACCGTCCTGCACCAGGACTGGCTGAATGGCAA
GGAGTACAAGTGCAAGGTCTCCAACAAAGCCCTCCCAGCCCCCATCGAGA
AAACCATCTCCAAAGCCAAAGGGCAGCCCCGAGAACCACAGGTGTACACC
CTGCCCCCATCCCGGGAGGAGATGACCAAGAACCAGGTCAGCCTGACCTG
CCTGGTCAAAGGCTTCTATCCCAGCGACATCGCCGTGGAGTGGGAGAGCA
ATGGGCAGCCGGAGAACAACTACAAGACCACGCCTCCCGTGCTGGACTCC
GACGGCTCCTTCTTCCTCTATAGCAAGCTCACCGTGGACAAGAGCAGGTG
GCAGCAGGGGAACGTCTTCTCATGCTCCGTGATGCATGAGGCTCTGCACA
ACCACTACACGCAGAAGAGCCTCTCCCTGTCCCCGGGTTGA |

TABLE 8-continued

| SEQ ID | Antibody | Description | Sequences |
|---|---|---|---|
| 238 | 17C3 | IgG1.3f HC (no C-terminal K | CAGGTGCAGTTGGTGCAGTCTGGGGCTGAGGTGAAGAAGCCTGGGGCCTC<br>AGTGAAGGTCTCCTGCAAGGCATCTGGATACACTTTCACCAGCTACTATA<br>TGCACTGGGTGCGACAGGCCCCTGGACAAGGGCTTGAGTGGATGGGAATA<br>ATCAACCCTAGGGGTGATAGCATAATCTACGCACAGAAGTTCCAGGGCAG<br>AGTCACCATGACCAGGGACACGTCCACGAGCACAGTCTACATGGAGCTGA<br>GCAGCCTGAGATCTGAGGACACGGCCGTGTATTACTGTGCGAGAGATTTC<br>TATGGTTCGGGAAACTACTACTACGGTATGGACGTCTGGGGCCAAGGGAC<br>CACGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 239 | 9F6 | IgG1.3f HC (no C-terminal K) | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTGGTGGTGGTAGTACCATATACTACGCAGACTCTGTGAAGGGCCG<br>ATTCACCATCTCCAGGGACAACGCCAAGAACTCGCTGTTTCTGCAAATGA<br>ACAGCCTGAGAGTCGAGGACACGGCTGTGTATTACTGTGCGAGAGATGGC<br>TATAGCAGTGGCTGGTACTACTACGGTATGGACGTCTGGGGCCAAGGGAC<br>CGCGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 240 | 3G4 | IgG1.3f HC (no C-terminal K) | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTACTAGTGGTAGTATCATATACTACGCAGACTCTGTGAAGGGCCG<br>ATTCACCATCTCCAGGGACAACGCCAAGAACTCACTGTATCTGCAAATGA<br>ACAGCCTGAGAGCCGAGGACACGGCTGTGTATTACTGTGCGAGAGAAGGG<br>TATAGCAGCAGCTGGTCCTACTACTACGGTATGGACGTCTGGGGCCAAGG<br>GACCACGGTCACCGTCTCCTCAGCTAGCACCAAGGGCCCATCGGTCTTCC<br>CCCTGGCACCCTCCTCCAAGAGCACCTCTGGGGGCACAGCGGCCCTGGGC<br>TGCCTGGTCAAGGACTACTTCCCCGAACCGGTGACGGTGTCGTGGAACTC<br>AGGCGCCCTGACCAGCGGCGTGCACACCTTCCCGGCTGTCCTACAGTCCT<br>CAGGACTCTACTCCCTCAGCAGCGTGGTGACCGTGCCCTCCAGCAGCTTG<br>GGCACCCAGACCTACATCTGCAACGTGAATCACAAGCCCAGCAACACCAA<br>GGTGGACAAGAGAGTTGAGCCCAAATCTTGTGACAAAACTCACACATGCC<br>CACCGTGCCCAGCACCTGAAGCCGAAGGGGCCCCGTCAGTCTTCCTCTTC<br>CCCCCAAAACCCAAGGACACCCTCATGATCTCCCGGACCCCTGAGGTCAC<br>ATGCGTGGTGGTGGACGTGAGCCACGAAGACCCTGAGGTCAAGTTCAACT<br>GGTACGTGGACGGCGTGGAGGTGCATAATGCCAAGACAAAGCCGCGGGAG |

TABLE 8-continued

| SEQ ID | Antibody | Description | Sequences |
|---|---|---|---|
| | | | GAGCAGTACAACAGCACGTACCGTGTGGTCAGCGTCCTCACCGTCCTGCA |
| | | | CCAGGACTGGCTGAATGGCAAGGAGTACAAGTGCAAGGTCTCCAACAAAG |
| | | | CCCTCCCAGCCCCCATCGAGAAAACCATCTCCAAAGCCAAAGGGCAGCCC |
| | | | CGAGAACCACAGGTGTACACCCTGCCCCCATCCCGGGAGGAGATGACCAA |
| | | | GAACCAGGTCAGCCTGACCTGCCTGGTCAAAGGCTTCTATCCCAGCGACA |
| | | | TCGCCGTGGAGTGGGAGAGCAATGGGCAGCCGGAGAACAACTACAAGACC |
| | | | ACGCCTCCCGTGCTGGACTCCGACGGCTCCTTCTTCCTCTATAGCAAGCT |
| | | | CACCGTGGACAAGAGCAGGTGGCAGCAGGGGAACGTCTTCTCATGCTCCG |
| | | | TGATGCATGAGGCTCTGCACAACCACTACACGCAGAAGAGCCTCTCCCTG |
| | | | TCCCCGGGTTGA |
| 241 | 17C8 | IgG1.3f HC (no C-terminal K) | CAGGTGCAGCTGGTGGAGTCTGGGGGAGGCTTGGTCAAGCCTGGAGGGTC |
| | | | CCTGAGACTCTCCTGTGCAGCCTCTGGATTCACCTTCAGTGACTACTACA |
| | | | TGAGCTGGATCCGCCAGGCTCCAGGGAAGGGGCTGGAGTGGGTTTCATTC |
| | | | ATTAGTAGTAGTGGTAGTATCATATACTACGCAGACTCTGTGAAGGGCCG |
| | | | ATTCACCATCTCCAGGGACAACGCCAAGAACTCACTGTATCTGCAAATGA |
| | | | ACAGCCTGAGAGCCGAGGACACGGCTGTGTATTACTGTGCGAGAGATGGG |
| | | | TATAGCAGTGGCTGGGAGTACTACGGTATGGACGTCTGGGGCCAAGGGAC |
| | | | CACGGTCACCGTCTCCTCAGCTAGCACCAAGGGCCCATCGGTCTTCCCCC |
| | | | TGGCACCCTCCTCCAAGAGCACCTCTGGGGGCACAGCGGCCCTGGGCTGC |
| | | | CTGGTCAAGGACTACTTCCCCGAACCGGTGACGGTGTCGTGGAACTCAGG |
| | | | CGCCCTGACCAGCGGCGTGCACACCTTCCCGGCTGTCCTACAGTCCTCAG |
| | | | GACTCTACTCCCTCAGCAGCGTGGTGACCGTGCCCTCCAGCAGCTTGGGC |
| | | | ACCCAGACCTACATCTGCAACGTGAATCACAAGCCCAGCAACACCAAGGT |
| | | | GGACAAGAGAGTTGAGCCCAAATCTTGTGACAAAACTCACACATGCCCAC |
| | | | CGTGCCCAGCACCTGAAGCCGAAGGGGCCCCGTCAGTCTTCCTCTTCCCC |
| | | | CCAAAACCCAAGGACACCCTCATGATCTCCCGGACCCCTGAGGTCACATG |
| | | | CGTGGTGGTGGACGTGAGCCACGAAGACCCTGAGGTCAAGTTCAACTGGT |
| | | | ACGTGGACGGCGTGGAGGTGCATAATGCCAAGACAAAGCCGCGGGAGGAG |
| | | | CAGTACAACAGCACGTACCGTGTGGTCAGCGTCCTCACCGTCCTGCACCA |
| | | | GGACTGGCTGAATGGCAAGGAGTACAAGTGCAAGGTCTCCAACAAAGCCC |
| | | | TCCCAGCCCCCATCGAGAAAACCATCTCCAAAGCCAAAGGGCAGCCCCGA |
| | | | GAACCACAGGTGTACACCCTGCCCCCATCCCGGGAGGAGATGACCAAGAA |
| | | | CCAGGTCAGCCTGACCTGCCTGGTCAAAGGCTTCTATCCCAGCGACATCG |
| | | | CCGTGGAGTGGGAGAGCAATGGGCAGCCGGAGAACAACTACAAGACCACG |
| | | | CCTCCCGTGCTGGACTCCGACGGCTCCTTCTTCCTCTATAGCAAGCTCAC |
| | | | CGTGGACAAGAGCAGGTGGCAGCAGGGGAACGTCTTCTCATGCTCCGTGA |
| | | | TGCATGAGGCTCTGCACAACCACTACACGCAGAAGAGCCTCTCCCTGTCC |
| | | | CCGGGTTGA |
| 242 | 13A3, 17C3, 3G4 | LC | GAAATTGTGTTGACGCAGTCTCCAGGCACCCTGTCTTTGTCTCCAGGGGA |
| | | | AAGAGCCACCCTCTCCTGCAGGGCCAGTCAGAGTGTTAGCAGCAGCTACT |
| | | | TAGCCTGGTACCAGCAGAAACCTGGCCAGGCTCCCAGGCTCCTCATCTAT |
| | | | GGTGCATCCAGCAGGGCCACTGGCATCCCAGACAGGTTCAGTGGCAGTGG |
| | | | GTCTGGGACAGACTTCACTCTCACCATCAGCAGACTGGAGCCTGAAGATT |
| | | | TTGCAGTGTATTACTGTCAGCAGTATGGTAGCTCACCGATCACCTTCGGC |
| | | | CAAGGGACACGACTGGAGATTAAACGTACGGTGGCTGCACCATCTGTCTT |
| | | | CATCTTCCCGCCATCTGATGAGCAGTTGAAATCTGGAACTGCCTCTGTTG |
| | | | TGTGCCTGCTGAATAACTTCTATCCCAGAGAGGCCAAAGTACAGTGGAAG |
| | | | GTGGATAACGCCCTCCAATCGGGTAACTCCCAGGAGAGTGTCACAGAGCA |
| | | | GGACAGCAAGGACAGCACCTACAGCCTCAGCAGCACCCTGACGCTGAGCA |
| | | | AAGCAGACTACGAGAAACACAAAGTCTACGCCTGCGAAGTCACCCATCAG |
| | | | GGCCTGAGCTCGCCCGTCACAAAGAGCTTCAACAGGGGAGAGTGTTAG |
| 243 | 8B9, 8C4, 17C8 | LC | GAAATTGTGTTGACGCAGTCTCCAGGCACCCTGTCTTTGTCTCCAGGGGA |
| | | | AAGAGCCACCCTCTCCTGCAGGGCCAGTCAGAGTGTTAGCAGCAGCTACT |
| | | | TAGCCTGGTACCAGCAGAAACCTGGCCAGGCTCCCAGGCTCCTCATCTAT |
| | | | GGTGCATCCAGCAGGGCCACTGGCATCCCAGACAGGTTCAGTGGCAGTGG |
| | | | GTCTGGGACAGACTTCACTCTCACCATCAGCAGACTGGAGCCTGAAGATT |
| | | | TTGCAGTGTATTACTGTCAGCAGTATGGTAGCTCACCTCTCACTTTCGGC |
| | | | GGAGGGACCAAGGTGGAGATCAAACGTACGGTGGCTGCACCATCTGTCTT |
| | | | CATCTTCCCGCCATCTGATGAGCAGTTGAAATCTGGAACTGCCTCTGTTG |
| | | | TGTGCCTGCTGAATAACTTCTATCCCAGAGAGGCCAAAGTACAGTGGAAG |
| | | | GTGGATAACGCCCTCCAATCGGGTAACTCCCAGGAGAGTGTCACAGAGCA |
| | | | GGACAGCAAGGACAGCACCTACAGCCTCAGCAGCACCCTGACGCTGAGCA |
| | | | AAGCAGACTACGAGAAACACAAAGTCTACGCCTGCGAAGTCACCCATCAG |
| | | | GGCCTGAGCTCGCCCGTCACAAAGAGCTTCAACAGGGGAGAGTGTTAG |
| 244 | 9F6 (VK3) | LC | GAAATTGTGTTGACGCAGTCTCCAGGCACCCTGTCTTTGTCTCCAGGGGA |
| | | | AAGAGCCACCCTCTCCTGCAGGGCCAGTCAGAGTGTTAGCAGCAGCTACT |
| | | | TAGCCTGGTACCAGCAGAAACCTGGCCAGGCTCCCAGGCTCCTCATCTAT |
| | | | GGTGCATCCAGCAGGGCCACTGGCATCCCAGACAGGTTCAGTGGCAGTGG |
| | | | GTCTGGGACAGACTTCACTCTCACCATCAGCAGACTGGAGCCTGAAGATT |
| | | | TTGCAGTGTATTACTGTCAGCAGTATGGTAGCTCACCGCTCACTTTCGGC |
| | | | GGAGGGACCAAGGTGGAGATCAAACGTACGGTGGCTGCACCATCTGTCTT |
| | | | CATCTTCCCGCCATCTGATGAGCAGTTGAAATCTGGAACTGCCTCTGTTG |
| | | | TGTGCCTGCTGAATAACTTCTATCCCAGAGAGGCCAAAGTACAGTGGAAG |

TABLE 8-continued

| SEQ ID | Antibody | Description | Sequences |
|---|---|---|---|
| | | | GTGGATAACGCCCTCCAATCGGGTAACTCCCAGGAGAGTGTCACAGAGCA<br>GGACAGCAAGGACAGCACCTACAGCCTCAGCAGCACCCTGACGCTGAGCA<br>AAGCAGACTACGAGAAACACAAAGTCTACGCCTGCGAAGTCACCCATCAG<br>GGCCTGAGCTCGCCCGTCACAAAGAGCTTCAACAGGGGAGAGTGTTAG |
| 245 | 9F6 (VK1) | LC | GCCATCCAGTTGACCCAGTCTCCATCCTCCCTGTCTGCATCTGTAGGAGA<br>CAGAGTCACCATCACTTGCCGGGCAAGTCAGGGCATTAGCAGTGCTTTAG<br>CCTGGTATCAGCAGAAACCAGGGAAAGCTCCTAAGCTCCTGATCTATGAT<br>GCCTCCAGTTTGGAAAGTGGGGTCCCATCAAGGTTCAGCGGCAGTGGATC<br>TGGGACAGATTTCACTCTCACCATCAGCAGCCTGCAGCCTGAAGATTTTG<br>CAACTTATTACTGTCAACAGTTTAATAGTTACCCTCGGACGTTCGGCCAA<br>GGGACCAAGGTGGAAATCAAACGTACGGTGGCTGCACCATCTGTCTTCAT<br>CTTCCCGCCATCTGATGAGCAGTTGAAATCTGGAACTGCCTCTGTTGTGT<br>GCCTGCTGAATAACTTCTATCCCAGAGAGGCCAAAGTACAGTGGAAGGTG<br>GATAACGCCCTCCAATCGGGTAACTCCCAGGAGAGTGTCACAGAGCAGGA<br>CAGCAAGGACAGCACCTACAGCCTCAGCAGCACCCTGACGCTGAGCAAAG<br>CAGACTACGAGAAACACAAAGTCTACGCCTGCGAAGTCACCCATCAGGGC<br>CTGAGCTCGCCCGTCACAAAGAGCTTCAACAGGGGAGAGTGTTAG |
| 246 | 9F6 (VK2) | LC | GAAATTGTGTTGACGCAGTCTCCAGGCACCCTGTCTTTGTCTCCAGGGGA<br>AAGAGCCACCCTCTCCTGCAGGGCCAGTCAGAGTGTTAGCAGCAGCTACT<br>TAGCCTGGTACCAGCAGAAACCTGGCCAGGCTCCCAGGCTCCTCATCTAT<br>GGTGCATCCAGCAGGGCCACTGGCATCCCAGACAGGTTCAGTGGCAGTGG<br>GTCTGGGACAGACTTCACTCTCACCATCAGCAGACTGGAGCCTGAAGATT<br>TTGCAGTGTATTACTGTCAGCAGTATGGTAGCTCACTCACTTTCGGCGGA<br>GGGACCAAGGTGGAGATCAAACGTACGGTGGCTGCACCATCTGTCTTCAT<br>CTTCCCGCCATCTGATGAGCAGTTGAAATCTGGAACTGCCTCTGTTGTGT<br>GCCTGCTGAATAACTTCTATCCCAGAGAGGCCAAAGTACAGTGGAAGGTG<br>GATAACGCCCTCCAATCGGGTAACTCCCAGGAGAGTGTCACAGAGCAGGA<br>CAGCAAGGACAGCACCTACAGCCTCAGCAGCACCCTGACGCTGAGCAAAG<br>CAGACTACGAGAAACACAAAGTCTACGCCTGCGAAGTCACCCATCAGGGC<br>CTGAGCTCGCCCGTCACAAAGAGCTTCAACAGGGGAGAGTGTTAG |
| 247 | 13A3 (N60Q) | IgG1.1f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 248 | 13A3 (N60S) | IgG1.1f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACTCACCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC |

TABLE 8-continued

| SEQ ID | Antibody | Description | Sequences |
|---|---|---|---|
| | | | CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 249 | 13A3 (N60A) | IgG1.1f HC | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCAGGGAAGGGGCTGGAGTGGATT GGGAGTATCTATTATAGTGGGTTCACCTACTACGCACCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACCCCTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 250 | 13A3 (D101E) | IgG1.1f HC | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCAGGGAAGGGGCTGGAGTGGATT GGGAGTATCTATTATAGTGGGTTCACCTACTACAACCCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGAACCCTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 251 | 13A3 (P102V) | IgG1.1f HC | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCAGGGAAGGGGCTGGAGTGGATT GGGAGTATCTATTATAGTGGGTTCACCTACTACAACCCGTCCCTCAAGAG TCGAGTCACCATATCCGTTGACACGTCCAAGAACCAGTTCTCCCTGAAGC |

TABLE 8-continued

| SEQ ID | Antibody | Description | Sequences |
|---|---|---|---|
| | | | TGAGCTCTGTGACCGCCGCAGACACGGCTGTGTATTATTGTGCGACAGGG
GGGCCCTACGGTGACTACGCCCACTGGTTCGACGTATGGGGCCAGGGAAC
CCTGGTCACCGTCTCCTCAGCTAGCACCAAGGGCCCATCGGTCTTCCCCC
TGGCACCCTCCTCCAAGAGCACCTCTGGGGGCACAGCGGCCCTGGGCTGC
CTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGC
ACCCAGACCTACATCTGCAACGTGAATCACAAGCCCAGCAACACCAAGGT
GGACAAGAGAGTTGAGCCCAAATCTTGTGACAAAACTCACACATGCCCAC
CGTGCCCAGCACCTGAAGCCGAAGGGGCCCCGTCAGTCTTCCTCTTCCCC
CCAAAACCCAAGGACACCCTCATGATCTCCCGGACCCCTGAGGTCACATG
CGTGGTGGTGGACGTGAGCCACGAAGACCCTGAGGTCAAGTTCAACTGGT
ACGTGGACGGCGTGGAGGTGCATAATGCCAAGACAAAGCCGCGGGAGGAG
CAGTACAACAGCACGTACCGTGTGGTCAGCGTCCTCACCGTCCTGCACCA
GGACTGGCTGAATGGCAAGGAGTACAAGTGCAAGGTCTCCAACAAAGCCC
TCCCAAGCAGCATCGAGAAAACCATCTCCAAAGCCAAAGGGCAGCCCCGA
GAACCACAGGTGTACACCCTGCCCCCATCCCGGGAGGAGATGACCAAGAA
CCAGGTCAGCCTGACCTGCCTGGTCAAAGGCTTCTATCCCAGCGACATCG
CCGTGGAGTGGGAGAGCAATGGGCAGCCGGAGAACAACTACAAGACCACG
CCTCCCGTGCTGGACTCCGACGGCTCCTTCTTCCTCTATAGCAAGCTCAC
CGTGGACAAGAGCAGGTGGCAGCAGGGGAACGTCTTCTCATGCTCCGTGA
TGCATGAGGCTCTGCACAACCACTACACGCAGAAGAGCCTCTCCCTGTCC
CCGGGTAAATGA |
| 252 | 13A3 (P102Y) | IgG1.1f HC | CAGCTGCAGCTGCAGGAGTCGGGCCCAGGACTGGTGAAGCCTTCGGAGAC
CCTGTCCCTCACCTGCACTGTCTCTGGTGGCTCCATCAGCAGTAGAAGTT
ACTACTGGGGCTGGATCCGCCAGCCCCCAGGGAAGGGGCTGGAGTGGATT
GGGAGTATCTATTATAGTGGGTTCACCTACTACAACCCGTCCCTCAAGAG
TCGAGTCACCATATCCGTTGACACGTCCAAGAACCAGTTCTCCCTGAAGC
TGAGCTCTGTGACCGCCGCAGACACGGCTGTGTATTATTGTGCGACAGGG
GGGCCCTACGGTGACTACGCCCACTGGTTCGACTACGGGGCCAGGGAAC
CCTGGTCACCGTCTCCTCAGCTAGCACCAAGGGCCCATCGGTCTTCCCCC
TGGCACCCTCCTCCAAGAGCACCTCTGGGGGCACAGCGGCCCTGGGCTGC
CTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGC
ACCCAGACCTACATCTGCAACGTGAATCACAAGCCCAGCAACACCAAGGT
GGACAAGAGAGTTGAGCCCAAATCTTGTGACAAAACTCACACATGCCCAC
CGTGCCCAGCACCTGAAGCCGAAGGGGCCCCGTCAGTCTTCCTCTTCCCC
CCAAAACCCAAGGACACCCTCATGATCTCCCGGACCCCTGAGGTCACATG
CGTGGTGGTGGACGTGAGCCACGAAGACCCTGAGGTCAAGTTCAACTGGT
ACGTGGACGGCGTGGAGGTGCATAATGCCAAGACAAAGCCGCGGGAGGAG
CAGTACAACAGCACGTACCGTGTGGTCAGCGTCCTCACCGTCCTGCACCA
GGACTGGCTGAATGGCAAGGAGTACAAGTGCAAGGTCTCCAACAAAGCCC
TCCCAAGCAGCATCGAGAAAACCATCTCCAAAGCCAAAGGGCAGCCCCGA
GAACCACAGGTGTACACCCTGCCCCCATCCCGGGAGGAGATGACCAAGAA
CCAGGTCAGCCTGACCTGCCTGGTCAAAGGCTTCTATCCCAGCGACATCG
CCGTGGAGTGGGAGAGCAATGGGCAGCCGGAGAACAACTACAAGACCACG
CCTCCCGTGCTGGACTCCGACGGCTCCTTCTTCCTCTATAGCAAGCTCAC
CGTGGACAAGAGCAGGTGGCAGCAGGGGAACGTCTTCTCATGCTCCGTGA
TGCATGAGGCTCTGCACAACCACTACACGCAGAAGAGCCTCTCCCTGTCC
CCGGGTAAATGA |
| 253 | 13A3 (P102L) | IgG1.1f HC | CAGCTGCAGCTGCAGGAGTCGGGCCCAGGACTGGTGAAGCCTTCGGAGAC
CCTGTCCCTCACCTGCACTGTCTCTGGTGGCTCCATCAGCAGTAGAAGTT
ACTACTGGGGCTGGATCCGCCAGCCCCCAGGGAAGGGGCTGGAGTGGATT
GGGAGTATCTATTATAGTGGGTTCACCTACTACAACCCGTCCCTCAAGAG
TCGAGTCACCATATCCGTTGACACGTCCAAGAACCAGTTCTCCCTGAAGC
TGAGCTCTGTGACCGCCGCAGACACGGCTGTGTATTATTGTGCGACAGGG
GGGCCCTACGGTGACTACGCCCACTGGTTCGACCTATGGGGCCAGGGAAC
CCTGGTCACCGTCTCCTCAGCTAGCACCAAGGGCCCATCGGTCTTCCCCC
TGGCACCCTCCTCCAAGAGCACCTCTGGGGGCACAGCGGCCCTGGGCTGC
CTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGC
ACCCAGACCTACATCTGCAACGTGAATCACAAGCCCAGCAACACCAAGGT
GGACAAGAGAGTTGAGCCCAAATCTTGTGACAAAACTCACACATGCCCAC
CGTGCCCAGCACCTGAAGCCGAAGGGGCCCCGTCAGTCTTCCTCTTCCCC
CCAAAACCCAAGGACACCCTCATGATCTCCCGGACCCCTGAGGTCACATG
CGTGGTGGTGGACGTGAGCCACGAAGACCCTGAGGTCAAGTTCAACTGGT
ACGTGGACGGCGTGGAGGTGCATAATGCCAAGACAAAGCCGCGGGAGGAG
CAGTACAACAGCACGTACCGTGTGGTCAGCGTCCTCACCGTCCTGCACCA
GGACTGGCTGAATGGCAAGGAGTACAAGTGCAAGGTCTCCAACAAAGCCC
TCCCAAGCAGCATCGAGAAAACCATCTCCAAAGCCAAAGGGCAGCCCCGA
GAACCACAGGTGTACACCCTGCCCCCATCCCGGGAGGAGATGACCAAGAA
CCAGGTCAGCCTGACCTGCCTGGTCAAAGGCTTCTATCCCAGCGACATCG
CCGTGGAGTGGGAGAGCAATGGGCAGCCGGAGAACAACTACAAGACCACG |

TABLE 8-continued

| SEQ ID | Antibody | Description | Sequences |
|---|---|---|---|
| | | | CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 254 | 13A3 (N60Q, P102Y) | IgG1.1f HC | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCCAGGGAAGGGGCTGGAGTGGATT GGGAGTATCTATTATAGTGGGTTCACCTACTACCAACCGTCCCTCAAGAG TCGAGTCACCATATCCGTTGACACGTCCAAGAACCAGTTCTCTCCCTGAAGC TGAGCTCTGTGACCGCCGCAGACACGGCTGTGTATTATTGTGCGACAGGG GGGCCCTACGGTGACTACGCCCACTGGTTCGACTACTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 255 | 8B9 (S61P) | IgG1.1f HC | CAGGTGCAGCTGCAGGAGTCGGGCCCAGGACTGGTGAAGCCTTCGGAGAC CCTGTCCCTCACCTGCACTGTCTCTGGTGGCTCCATCAGTCGTCACTACT GGAACTGGATCCGGCAGCCCCCAGGGAAGGGACTGGAGTGGATTGGGTAT ATCCATTACAGTGGAAGCACCAACTACAATCCCTCCCTCAAGAGTCGAGT CACCATATCAGTAGACACGTCCAAGAACCAGTTCTCTCCTGAAGCTGAGCT CTGTGACCGCTGCGGACACGGCCGTGTATTACTGTGCGAGAGATACTGGG TACTACGGTATGGACATCTGGGGCCAAGGGACCACGGTCACCGTCTCCTC AGCTAGCACCAAGGGCCCATCGGTCTTCCCCCTGGCACCCTCCTCCAAGA GCACCTCTGGGGGCACAGCGGCCCTGGGCTGCCTGGTCAAGGACTACTTC CCCGAACCGGTGACGGTGTCGTGGAACTCAGGCGCCCTGACCAGCGGCGT GCACACCTTCCCGGCTGTCCTACAGTCCTCAGGACTCTACTCCCTCAGCA GCGTGGTGACCGTGCCCTCCAGCAGCTTGGGCACCCAGACCTACATCTGC AACGTGAATCACAAGCCCAGCAACACCAAGGTGGACAAGAGAGTTGAGCC CAAATCTTGTGACAAAACTCACACATGCCCACCGTGCCCAGCACCTGAAG CCGAAGGGGCCCCGTCAGTCTTCCTCTTCCCCCCAAAACCCAAGGACACC CTCATGATCTCCCGGACCCCTGAGGTCACATGCGTGGTGGTGGACGTGAG CCACGAAGACCCTGAGGTCAAGTTCAACTGGTACGTGGACGGCGTGGAGG TGCATAATGCCAAGACAAAGCCGCGGGAGGAGCAGTACAACAGCACGTAC CGTGTGGTCAGCGTCCTCACCGTCCTGCACCAGGACTGGCTGAATGGCAA GGAGTACAAGTGCAAGGTCTCCAACAAAGCCCTCCCAAGCAGCATCGAGA AAACCATCTCCAAAGCCAAAGGGCAGCCCCGAGAACCACAGGTGTACACC CTGCCCCCATCCCGGGAGGAGATGACCAAGAACCAGGTCAGCCTGACCTG CCTGGTCAAAGGCTTCTATCCCAGCGACATCGCCGTGGAGTGGGAGAGCA ATGGGCAGCCGGAGAACAACTACAAGACCACGCCTCCCGTGCTGGACTCC GACGGCTCCTTCTTCCTCTATAGCAAGCTCACCGTGGACAAGAGCAGGTG GCAGCAGGGGAACGTCTTCTCATGCTCCGTGATGCATGAGGCTCTGCACA ACCACTACACGCAGAAGAGCCTCTCCCTGTCCCCGGGTAAATGA |
| 256 | 9F6 (A108T) | IgG1.1f HC | CAGGTGCAGCTGGTGGAGTCTGGGGGAGGCTTGGTCAAGCCTGGAGGGTC CCTGAGACTCTCTGTGCAGCCTCTGGATTCACCTTCAGTGACTACTACA TGAGCTGGATCCGCCAGGCTCCAGGGAAGGGGCTGGAGTGGGTTTCATTC ATTAGTGGTGGTAGTACCATATACTACGCAGACTCTGTGAAGGGCCG ATTCACCATCTCCAGGGACAACGCCAAGAACTCGCTGTTTCTGCAAATGA ACAGCCTGAGAGTCGAGGACACGGCTGTGTATTACTGTGCGAGAGATGCC TATAGCAGTGGCTGGTACTACTACGGTATGGACGTCTGGGGCCAAGGGAC CACGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC |

TABLE 8-continued

| SEQ ID | Antibody | Description | Sequences |
|---|---|---|---|
| | | | CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 257 | 13A3 (N60Q) | IgG1.1f HC (no C-terminal K) | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCAGGGAAGGGGCTGGAGTGGATT GGGAGTATCTATTATAGTGGGTTCACCTACTACCAACCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACCCCTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTTGA |
| 258 | 13A3 (N60S) | IgG1.1f HC (no C-terminal K) | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCAGGGAAGGGGCTGGAGTGGATT GGGAGTATCTATTATAGTGGGTTCACCTACTACCAACCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACCCCTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTTGA |
| 259 | 13A3 (N60A) | IgG1.1f HC (no C-terminal K) | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCAGGGAAGGGGCTGGAGTGGATT GGGAGTATCTATTATAGTGGGTTCACCTACTACCACCGTCCCTCAAGAG TCGAGTCACCATATCCGTTGACACGTCCAAGAACCAGTTCTCCCTGAAGC |

TABLE 8-continued

| SEQ ID | Antibody | Description | Sequences |
|---|---|---|---|
| | | | TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 260 | 13A3 (D101E) | IgG1.1f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGAACCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 261 | 13A3 (P102V) | IgG1.1f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACGTATGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG |

TABLE 8-continued

| SEQ ID | Antibody | Description | Sequences |
|---|---|---|---|
| | | | CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTTGA |
| 262 | 13A3 (P102Y) | IgG1.1f HC (no C-terminal K) | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCCAGGGAAGGGGCTGGAGTGGATT GGGAGTATCTATTATAGTGGGTTCACCTACTACAACCCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACTACTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTTGA |
| 263 | 13A3 (P102L) | IgG1.1f HC (no C-terminal K) | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCCAGGGAAGGGGCTGGAGTGGATT GGGAGTATCTATTATAGTGGGTTCACCTACTACAACCCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACCTATGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAAGCAGCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTTGA |
| 264 | 13A3 (N60Q, P102Y) | IgG1.1f HC (no C-terminal K) | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCCAGGGAAGGGGCTGGAGTGGATT GGGAGTATCTATTATAGTGGGTTCACCTACTACAACCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACTACTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC |

TABLE 8-continued

| SEQ ID | Antibody | Description | Sequences |
|---|---|---|---|
| | | | CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 265 | 8B9 (S61P) | IgG1.1f HC (no C-terminal K) | CAGGTGCAGCTGCAGGAGTCGGGCCCAGGACTGGTGAAGCCTTCGGAGAC<br>CCTGTCCCTCACCTGCACTGTCTCTGGTGGCTCCATCAGTCGTCACTACT<br>GGAACTGGATCCGGCAGCCCCCAGGGAAGGGACTGGAGTGGATTGGGTAT<br>ATCCATTACAGTGGAAGCACCAACTACAATCCCTCCCTCAAGAGTCGAGT<br>CACCATATCAGTAGACACGTCCAAGAACCAGTTCTCCCTGAAGCTGAGCT<br>CTGTGACCGCTGCGGACACGGCCGTGTATTACTGTGCGAGAGATACTGGG<br>TACTACGGTATGGACATCTGGGGCCAAGGGACCACGGTCACCGTCTCCTC<br>AGCTAGCACCAAGGGCCCATCGGTCTTCCCCCTGGCACCCTCCTCCAAGA<br>GCACCTCTGGGGGCACAGCGGCCCTGGGCTGCCTGGTCAAGGACTACTTC<br>CCCGAACCGGTGACGGTGTCGTGGAACTCAGGCGCCCTGACCAGCGGCGT<br>GCACACCTTCCCGGCTGTCCTACAGTCCTCAGGACTCTACTCCCTCAGCA<br>GCGTGGTGACCGTGCCCTCCAGCAGCTTGGGCACCCAGACCTACATCTGC<br>AACGTGAATCACAAGCCCAGCAACACCAAGGTGGACAAGAGAGTTGAGCC<br>CAAATCTTGTGACAAAACTCACACATGCCCACCGTGCCCAGCACCTGAAG<br>CCGAAGGGGCCCCGTCAGTCTTCCTCTTCCCCCCAAAACCCAAGGACACC<br>CTCATGATCTCCCGGACCCCTGAGGTCACATGCGTGGTGGTGGACGTGAG<br>CCACGAAGACCCTGAGGTCAAGTTCAACTGGTACGTGGACGGCGTGGAGG<br>TGCATAATGCCAAGACAAAGCCGCGGGAGGAGCAGTACAACAGCACGTAC<br>CGTGTGGTCAGCGTCCTCACCGTCCTGCACCAGGACTGGCTGAATGGCAA<br>GGAGTACAAGTGCAAGGTCTCCAACAAAGCCCTCCCAAGCAGCATCGAGA<br>AAACCATCTCCAAAGCCAAAGGGCAGCCCCGAGAACCACAGGTGTACACC<br>CTGCCCCCATCCCGGGAGGAGATGACCAAGAACCAGGTCAGCCTGACCTG<br>CCTGGTCAAAGGCTTCTATCCCAGCGACATCGCCGTGGAGTGGGAGAGCA<br>ATGGGCAGCCGGAGAACAACTACAAGACCACGCCTCCCGTGCTGGACTCC<br>GACGGCTCCTTCTTCCTCTATAGCAAGCTCACCGTGGACAAGAGCAGGTG<br>GCAGCAGGGGAACGTCTTCTCATGCTCCGTGATGCATGAGGCTCTGCACA<br>ACCACTACACGCAGAAGAGCCTCTCCCTGTCCCCGGGTTGA |
| 266 | 9F6 (A108T) | IgG1.1f HC (no C-terminal K) | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTAGTGGTGGTAGTACCATATACTACGCAGACTCTGTGAAGGGCCG<br>ATTCACCATCTCCAGGGACAACGCCAAGAACTCGCTGTTTCTGCAAATGA<br>ACAGCCTGAGAGTCGAGGACACGGCTGTGTATTACTGTGCGAGAGATGGC<br>TATAGCAGTGGCTGGTACTACTACGGTATGGACGTCTGGGGCCAAGGGAC<br>CACGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 267 | 13A3 (N60Q) | IgG1.3f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACCGTCCCTCAAGAG<br>TCGAGTCACCATATCCGTTGACACGTCCAAGAACCAGTTCTCCCTGAAGC |

US 11,787,859 B2

153 154

TABLE 8-continued

| SEQ ID | Antibody | Description | Sequences |
|---|---|---|---|
| | | | TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 268 | 13A3<br>(N60S) | IgG1.3f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACTCACCGTCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 269 | 13A3<br>(N60A) | IgG1.3f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACGCACCGTCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG |

TABLE 8-continued

| SEQ ID | Antibody | Description | Sequences |
|---|---|---|---|
| | | | CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 270 | 13A3 (D101E) | IgG1.3f HC | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCCAGGGAAGGGGCTGGAGTGGATT GGGAGTATCTATTATAGTGGGTTCACCTACTACAACCCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGAACCCGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAGCCCCCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 271 | 13A3 (P102V) | IgG1.3f HC | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCCAGGGAAGGGGCTGGAGTGGATT GGGAGTATCTATTATAGTGGGTTCACCTACTACAACCCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACTATGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC CGTGCCCAGCACCTGAAGCCGAAGGGGCCCCGTCAGTCTTCCTCTTCCCC CCAAAACCCAAGGACACCCTCATGATCTCCCGGACCCCTGAGGTCACATG CGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAG CAGTACAACAGCACGTACCGTGTGGTCAGCGTCCTCACCGTCCTGCACCA GGACTGGCTGAATGGCAAGGAGTACAAGTGCAAGGTCTCCAACAAAGCCC TCCCAGCCCCCATCGAGAAAACCATCTCCAAAGCCAAAGGGCAGCCCCGA GAACCACAGGTGTACACCCTGCCCCCATCCCGGGAGGAGATGACCAAGAA CCAGGTCAGCCTGACCTGCCTGGTCAAAGGCTTCTATCCCAGCGACATCG CCGTGGAGTGGGAGAGCAATGGGCAGCCGGAGAACAACTACAAGACCACG CCTCCCGTGCTGGACTCCGACGGCTCCTTCTTCCTCTATAGCAAGCTCAC CGTGGACAAGAGCAGGTGGCAGCAGGGGAACGTCTTCTCATGCTCCGTGA TGCATGAGGCTCTGCACAACCACTACACGCAGAAGAGCCTCTCCCTGTCC CCGGGTAAATGA |
| 272 | 13A3 (P102Y) | IgG1.3f HC | CAGCTGCAGCTGCAGGAGTCGGGCCCAGGACTGGTGAAGCCTTCGGAGAC CCTGTCCCTCACCTGCACTGTCTCTGGTGGCTCCATCAGCAGTAGAAGTT ACTACTGGGGCTGGATCCGCCAGCCCCCAGGGAAGGGGCTGGAGTGGATT GGGAGTATCTATTATAGTGGGTTCACCTACTACAACCCGTCCCTCAAGAG TCGAGTCACCATATCCGTTGACACGTCCAAGAACCAGTTCTCCCTGAAGC TGAGCTCTGTGACCGCCGCAGACACGGCTGTGTATTATTGTGCGACAGGG GGGCCCTACGGTGACTACGCCCACTGGTTCGACTACTGGGGCCAGGGAAC CCTGGTCACCGTCTCCTCAGCTAGCACCAAGGGCCCATCGGTCTTCCCCC TGGCACCCTCCTCCAAGAGCACCTCTGGGGGCACAGCGGCCCTGGGCTGC CTGGTCAAGGACTACTTCCCCGAACCGGTGACGGTGTCGTGGAACTCAGG CGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGC ACCCAGACCTACATCTGCAACGTGAATCACAAGCCCAGCAACACCAAGGT GGACAAGAGAGTTGAGCCCAAATCTTGTGACAAAACTCACACATGCCCAC |

TABLE 8-continued

| SEQ ID | Antibody | Description | Sequences |
|---|---|---|---|
| | | | CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 273 | 13A3<br>(P102L) | IgG1.3f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACTACTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 274 | 13A3<br>(N60Q,<br>P102Y) | IgG1.3f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACTACTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 275 | 8B9<br>(S61P) | IgG1.3f HC | CAGGTGCAGCTGCAGGAGTCGGGCCCAGGACTGGTGAAGCCTTCGGAGAC<br>CCTGTCCCTCACCTGCACTGTCTCTGGTGGCTCCATCAGTCGTCACTACT<br>GGAACTGGATCCGGCAGCCCCCAGGGAAGGGACTGGAGTGGATTGGGTAT<br>ATCCATTACAGTGGAAGCACCAACTACAATCCCTCCCTCAAGAGTCGAGT |

TABLE 8-continued

| SEQ ID | Antibody | Description | Sequences |
|---|---|---|---|
| | | | CACCATATCAGTAGACACGTCCAAGAACCAGTTCTCCCTGAAGCTGAGCT<br>CTGTGACCGCTGCGGACACGGCCGTGTATTACTGTGCGAGAGATACTGGG<br>TACTACGGTATGGACATCTGGGGCCAAGGGACCACGGTCACCGTCTCCTC<br>AGCTAGCACCAAGGGCCCATCGGTCTTCCCCCTGGCACCCTCCTCCAAGA<br>GCACCTCTGGGGGCACAGCGGCCCTGGGCTGCCTGGTCAAGGACTACTTC<br>CCCGAACCGGTGACGGTGTCGTGGAACTCAGGCGCCCTGACCAGCGGCGT<br>GCACACCTTCCCGGCTGTCCTACAGTCCTCAGGACTCTACTCCCTCAGCA<br>GCGTGGTGACCGTGCCCTCCAGCAGCTTGGGCACCCAGACCTACATCTGC<br>AACGTGAATCACAAGCCCAGCAACACCAAGGTGGACAAGAGAGTTGAGCC<br>CAAATCTTGTGACAAAACTCACACATGCCCACCGTGCCCAGCACCTGAAG<br>CCGAAGGGGCCCCGTCAGTCTTCCTCTTCCCCCCAAAACCCAAGGACACC<br>CTCATGATCTCCCGGACCCCTGAGGTCACATGCGTGGTGGTGGACGTGAG<br>CCACGAAGACCCTGAGGTCAAGTTCAACTGGTACGTGGACGGCGTGGAGG<br>TGCATAATGCCAAGACAAAGCCGCGGGAGGAGCAGTACAACAGCACGTAC<br>CGTGTGGTCAGCGTCCTCACCGTCCTGCACCAGGACTGGCTGAATGGCAA<br>GGAGTACAAGTGCAAGGTCTCCAACAAAGCCCTCCCAGCCCCCATCGAGA<br>AAACCATCTCCAAAGCCAAAGGGCAGCCCCGAGAACCACAGGTGTACACC<br>CTGCCCCCATCCCGGGAGGAGATGACCAAGAACCAGGTCAGCCTGACCTG<br>CCTGGTCAAAGGCTTCTATCCCAGCGACATCGCCGTGGAGTGGGAGAGCA<br>ATGGGCAGCCGGAGAACAACTACAAGACCACGCCTCCCGTGCTGGACTCC<br>GACGGCTCCTTCTTCCTCTATAGCAAGCTCACCGTGGACAAGAGCAGGTG<br>GCAGCAGGGGAACGTCTTCTCATGCTCCGTGATGCATGAGGCTCTGCACA<br>ACCACTACACGCAGAAGAGCCTCTCCCTGTCCCCGGGTAAATGA |
| 276 | 9F6 (A108T) | IgG1.3f HC | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTAGTGGTGGTGGTAGTACCATATACTACGCAGACTCTGTGAAGGGCCG<br>ATTCACCATCTCCAGGGACAACGCCAAGAACTCGCTGTTTCTGCAAATGA<br>ACAGCCTGAGAGTCGAGGACACGGCTGTGTATTACTGTGCGAGAGATGGC<br>TATAGCAGTGGCTGGTACTACTACGGTATGGACGTCTGGGGCCAAGGGAC<br>CACGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 277 | 13A3 (N60Q) | IgG1.3f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG |

TABLE 8-continued

| SEQ ID | Antibody | Description | Sequences |
|---|---|---|---|
| | | | CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 278 | 13A3<br>(N60S) | IgG1.3f HC<br>(no C-<br>terminal<br>K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCAGGGAAGGGGCTGGAGTGGATT<br>GGGAGTATCTATTATAGTGGGTTCACCTACTACTCACCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 279 | 13A3<br>(N60A) | IgG1.3f HC<br>(no C-<br>terminal<br>K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCAGGGAAGGGGCTGGAGTGGATT<br>GGGAGTATCTATTATAGTGGGTTCACCTACTACGCACCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 280 | 13A3<br>(D101E) | IgG1.3f HC<br>(no C-<br>terminal<br>K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGAACCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC |

TABLE 8-continued

| SEQ ID | Antibody | Description | Sequences |
|---|---|---|---|
| | | | CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 281 | 13A3 (P102V) | IgG1.3f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACGTATGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 282 | 13A3 (P102Y) | IgG1.3f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACTACTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 283 | 13A3 (P102L) | IgG1.3f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACAACCCGTCCCTCAAGAG |

TABLE 8-continued

| SEQ ID | Antibody | Description | Sequences |
|---|---|---|---|
| | | | TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACCTATGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 284 | 13A3 (N60Q, P102Y) | IgG1.3f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGACTACGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 285 | 8B9 (S61P) | IgG1.3f HC (no C-terminal K) | CAGGTGCAGCTGCAGGAGTCGGGCCCAGGACTGGTGAAGCCTTCGGAGAC<br>CCTGTCCCTCACCTGCACTGTCTCTGGTGGCTCCATCAGTCGTCACTACT<br>GGAACTGGATCCGGCAGCCCCCAGGGAAGGGACTGGAGTGGATTGGGTAT<br>ATCCATTACAGTGGAAGCACCAACTACAATCCCTCCCTCAAGAGTCGAGT<br>CACCATATCAGTAGACACGTCCAAGAACCAGTTCTCCCTGAAGCTGAGCT<br>CTGTGACCGCTGCGGACACGGCCGTGTATTACTGTGCGAGAGATACTGGG<br>TACTACGGTATGGACATCTGGGGCCAAGGGACCACGGTCACCGTCTCCTC<br>AGCTAGCACCAAGGGCCCATCGGTCTTCCCCCTGGCACCCTCCTCCAAGA<br>GCACCTCTGGGGGCACAGCGGCCCTGGGCTGCCTGGTCAAGGACTACTTC<br>CCCGAACCGGTGACGGTGTCGTGGAACTCAGGCGCCCTGACCAGCGGCGT<br>GCACACCTTCCCGGCTGTCCTACAGTCCTCAGGACTCTACTCCCTCAGCA<br>GCGTGGTGACCGTGCCCTCCAGCAGCTTGGGCACCCAGACCTACATCTGC<br>AACGTGAATCACAAGCCCAGCAACACCAAGGTGGACAAGAGAGTTGAGCC<br>CAAATCTTGTGACAAAACTCACACATGCCCACCGTGCCCAGCACCTGAAG<br>CCGAAGGGGCCCCGTCAGTCTTCCTCTTCCCCCCAAAACCCAAGGACACC<br>CTCATGATCTCCCGGACCCCTGAGGTCACATGCGTGGTGGTGGACGTGAG<br>CCACGAAGACCCTGAGGTCAAGTTCAACTGGTACGTGGACGGCGTGGAGG<br>TGCATAATGCCAAGACAAAGCCGCGGGAGGAGCAGTACAACAGCACGTAC<br>CGTGTGGTCAGCGTCCTCACCGTCCTGCACCAGGACTGGCTGAATGGCAA<br>GGAGTACAAGTGCAAGGTCTCCAACAAAGCCCTCCCAGCCCCCATCGAGA<br>AAACCATCTCCAAAGCCAAAGGGCAGCCCCGAGAACCACAGGTGTACACC<br>CTGCCCCCATCCCGGGAGGAGATGACCAAGAACCAGGTCAGCCTGACCTG<br>CCTGGTCAAAGGCTTCTATCCCAGCGACATCGCCGTGGAGTGGGAGAGCA |

TABLE 8-continued

| SEQ ID | Antibody | Description | Sequences |
|---|---|---|---|
| | | | ATGGGCAGCCGGAGAACAACTACAAGACCACGCCTCCCGTGCTGGACTCC<br>GACGGCTCCTTCTTCCTCTATAGCAAGCTCACCGTGGACAAGAGCAGGTG<br>GCAGCAGGGGAACGTCTTCTCATGCTCCGTGATGCATGAGGCTCTGCACA<br>ACCACTACACGCAGAAGAGCCTCTCCCTGTCCCCGGGTTGA |
| 286 | 9F6 (A108T) | IgG1.3f HC (no C-terminal K) | CAGGTGCAGCTGGTGGAGTCTGGGGGAGGCTTGGTCAAGCCTGGAGGGTC<br>CCTGAGACTCTCCTGTGCAGCCTCTGGATTCACCTTCAGTGACTACTACA<br>TGAGCTGGATCCGCCAGGCTCCAGGGAAGGGGCTGGAGTGGGTTTCATTC<br>ATTAGTGGTGGTGGTAGTACCATATACTACGCAGACTCTGTGAAGGGCCG<br>ATTCACCATCTCCAGGGACAACGCCAAGAACTCGCTGTTTCTGCAAATGA<br>ACAGCCTGAGAGTCGAGGACACGGCTGTGTATTACTGTGCGAGAGATGGC<br>TATAGCAGTGGCTGGTACTACTACGGTATGGACGTCTGGGGCCAAGGGAC<br>CACGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 287 | 13A3 (N60Q, D101E) | IgG1.1f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGAACCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 288 | 13A3 (N60Q, D101E) | IgG1.1f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGAACCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC |

TABLE 8-continued

| SEQ ID | Antibody | Description | Sequences |
|---|---|---|---|
| | | | CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAAGCAGCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 289 | 13A3 (N60Q, D101E) | IgG1.3f HC | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGAACCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTAAATGA |
| 290 | 13A3 (N60Q, D101E) | IgG1.3f HC (no C-terminal K) | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATCCGCCAGCCCCCAGGGAAGGGGCTGGAGTGGATT<br>GGGAGTATCTATTATAGTGGGTTCACCTACTACCAACCGTCCCTCAAGAG<br>TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGAACCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 291 | 13A3 (N60Q, D101E) (TIM3.18) | IgG1.3f (T168C) (no C-terminal | CAGCTGCAGCTGCAGGAGTCGGGCCCAGGACTGGTGAAGCCTTCGGAGAC<br>CCTGTCCCTCACCTGCACTGTCTCTGGTGGCTCCATCAGCAGTAGAAGTT<br>ACTACTGGGGCTGGATTCGCCAGCCCCCAGGGAAGGGGCTGGAGTGGATT<br>GGGAGTATCTATTATAGTGGGTTCACCTACTACCAACCGTCCCTCAAGAG |

TABLE 8-continued

| SEQ ID | Antibody | Description | Sequences |
|---|---|---|---|
| | | K) | TCGAGTCACCATATCCGTTGACACGTCCAAGAACCAGTTCTCCCTGAAGC<br>TGAGCTCTGTGACCGCCGCAGACACGGCTGTGTATTATTGTGCGACAGGG<br>GGGCCCTACGGTGACTACGCCCACTGGTTCGAACCCTGGGGCCAGGGAAC<br>CCTGGTCACCGTCTCCTCAGCTAGCACCAAGGGCCCATCGGTCTTCCCCC<br>TGGCACCCTCCTCCAAGAGCACCTCTGGGGGCACAGCGGCCCTGGGCTGC<br>CTGGTCAAGGACTACTTCCCCGAACCGGTGACGGTGTCGTGGAACTCAGG<br>CGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGC<br>ACCCAGACCTACATCTGCAACGTGAATCACAAGCCCAGCAACACCAAGGT<br>GGACAAGAGAGTTGAGCCCAAATCTTGTGACAAAACTCACACATGCCCAC<br>CGTGCCCAGCACCTGAAGCCGAAGGGGCCCCGTCAGTCTTCCTCTTCCCC<br>CCAAAACCCAAGGACACCCTCATGATCTCCCGGACCCCTGAGGTCACATG<br>CGTGGTGGTGGACGTGAGCCACGAAGACCCTGAGGTCAAGTTCAACTGGT<br>ACGTGGACGGCGTGGAGGTGCATAATGCCAAGACAAAGCCGCGGGAGGAG<br>CAGTACAACAGCACGTACCGTGTGGTCAGCGTCCTCACCGTCCTGCACCA<br>GGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGA<br>GAACCACAGGTGTACACCCTGCCCCCATCCCGGGAGGAGATGACCAAGAA<br>CCAGGTCAGCCTGACCTGCCTGGTCAAAGGCTTCTATCCCAGCGACATCG<br>CCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCAC<br>CGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCC<br>CCGGGTTGA |
| 292 | 13A3<br>(N60Q,<br>D101E)<br>(TIM3.18) | IgG1.3f HC<br>with<br>signal<br>peptide<br>(underline) | <u>MRAWIFFLLCLAGRALA</u>QLQLQESGPGLVKPSETLSLTCTVSGGSISSRS<br>YYWGWIRQPPGEGLEWIGSIYYSGFTYYQPSLKSRVTISVDTSKNQFSLK<br>LESVTAADTAVYYCATGGPYGDYAHWFEPWGQGTLVTVSSASTKGPSVFP<br>LAPSSESTEGGTAALGCLVKDYFPEPVTVEWNSGALTSGVHTFPAVLQSS<br>GLYSLKSVVTVPSSELGTQTYICNVNHEPENTEVDERVEPESCDKTHTCP<br>PCPAPEAEGAPSVFLFPPEPEDTLMISRTPEVTCVVVDVSHEDPEVKFNW<br>YVDGVEVHNAKTKPREEQYNSTYRVVSVLTVLHQDWLNGKEYKCKVSNKA<br>LPAPIEKTISKAKGQPREPQVYTLPPEREEMTENQVSLTCLVKGFYPSDI<br>AVEWEENGQPENNYKTTPPVLDSDGEFFLYSKLTVDKSRWQQGNVESCSV<br>MHEALHNHYTQESLKLSPGK* |
| 293 | 13A3<br>(N60Q,<br>D101E)<br>(TIM3.18) | IgG1.3f HC<br>(no C-<br>terminal<br>K) with<br>signal<br>peptide<br>(underline) | <u>MRAWIFFLLCLAGRALA</u>QLQLQESGPGLVKPSETLSLTCTVSGGSISSRS<br>YYWGWIRQPPGEGLEWIGSIYYSGFTYYQPSLKSRVTISVDTSKNQFSLK<br>LESVTAADTAVYYCATGGPYGDYAHWFEPWGQGTLVTVSSASTKGPSVFP<br>LAPSSESTEGGTAALGCLVKDYFPEPVTVEWNSGALTSGVHTFPAVLQSS<br>GLYSLKSVVTVPSSELGTQTYICNVNHEPENTEVDERVEPESCDKTHTCP<br>PCPAPEAEGAPSVFLFPPEPEDTLMISRTPEVTCVVVDVSHEDPEVKFNW<br>YVDGVEVHNAKTKPREEQYNSTYRVVSVLTVLHQDWLNGKEYKCKVSNKA<br>LPAPIEKTISKAKGQPREPQVYTLPPEREEMTENQVSLTCLVKGFYPSDI<br>AVEWEENGQPENNYKTTPPVLDSDGEFFLYSKLTVDKSRWQQGNVESCSV<br>MHEALHNHYTQESLKLSPG* |
| 294 | 13A3<br>(N60Q,<br>D101E)<br>(TIM3.18) | IgG1.3f HC<br>with<br>signal<br>peptide<br>(underline) | <u>ATGAGGGCTTGGATCTTCTTTCTGCTCTGCCTGGCCGGGAGAGCGCTCGC</u><br><u>ACAGCTGCAGCTGCAGGAGTCGGGCCCAGGACTGGTGAAGCCTTCGGAGA</u><br>CCCTGTCCCTCACCTGCACTGTCTCTGGTGGCTCCATCAGCAGTAGAAGT<br>TACTACTGGGGCTGGATCCGCCAGCCCCCAGGGAAGGGGCTGGAGTGGAT<br>TGGGAGTATCTATTATAGTGGGTTCACCTACTACCAACCGTCCCTCAAGA<br>GTCGAGTCACCATATCCGTTGACACGTCCAAGAACCAGTTCTCCCTGAAG<br>CTGAGCTCTGTGACCGCCGCAGACACGGCTGTGTATTATTGTGCGACAGG<br>GGGGCCCTACGGTGACTACGCCCACTGGTTCGAACCCTGGGGCCAGGGAA<br>CCCTGGTCACCGTCTCCTCAGCTAGCACCAAGGGCCCATCGGTCTTCCCC<br>CTGGCACCCTCCTCCAAGAGCACCTCTGGGGGCACAGCGGCCCTGGGCTG<br>CCTGGTCAAGGACTACTTCCCCGAACCGGTGACGGTGTCGTGGAACTCAG<br>GCGCCCTGACCAGCGGCGTGCACACCTTCCCGGCTGTCCTACAGTCCTCA<br>GGACTCTACTCCCTCAGCAGCGTGGTGACCGTGCCCTCCAGCAGCTTGGG<br>CACCCAGACCTACATCTGCAACGTGAATCACAAGCCCAGCAACACCAAGG<br>TGGACAAGAGAGTTGAGCCCAAATCTTGTGACAAAACTCACACATGCCCA<br>CCGTGCCCAGCACCTGAAGCCGAAGGGGCCCCGTCAGTCTTCCTCTTCCC<br>CCCAAAACCCAAGGACACCCTCATGATCTCCCGGACCCCTGAGGTCACAT<br>GCGTGGTGGTGGACGTGAGCCACGAAGACCCTGAGGTCAAGTTCAACTGG<br>TACGTGGACGGCGTGGAGGTGCATAATGCCAAGACAAAGCCGCGGGAGGA<br>GCAGTACAACAGCACGTACCGTGTGGTCAGCGTCCTCACCGTCCTGCACC<br>AGGACTGGCTGAATGGCAAGGAGTACAAGTGCAAGGTCTCCAACAAAGCC<br>CTCCCAGCCCCCATCGAGAAAACCATCTCCAAAGCCAAAGGGCAGCCCCG<br>AGAACCACAGGTGTACACCCTGCCCCCATCCCGGGAGGAGATGACCAAGA<br>ACCAGGTCAGCCTGACCTGCCTGGTCAAAGGCTTCTATCCCAGCGACATC<br>GCCGTGGAGTGGGAGAGCAATGGGCAGCCGGAGAACAACTACAAGACCAC<br>GCCTCCCGTGCTGGACTCCGACGGCTCCTTCTTCCTCTATAGCAAGCTCA<br>CCGTGGACAAGAGCAGGTGGCAGCAGGGGAACGTCTTCTCATGCTCCGTG<br>ATGCATGAGGCTCTGCACAACCACTACACGCAGAAGAGCCTCTCCCTGTC<br>CCCGGGTAAATGA |

TABLE 8-continued

| SEQ ID | Antibody | Description | Sequences |
|---|---|---|---|
| 295 | 13A3 (N60Q, D101E) (TIM3.18) | IgG1.3f HC (no C-terminal K) with signal peptide (underline) | <u>ATGAGGGCTTGGATCTTCTTTCTGCTCTGCCTGGCCGGGAGAGCGCTCGC<br>A</u>CAGCTGCAGCTGCAGGAGTCGGGCCCAGGACTGGTGAAGCCTTCGGAGA<br>CCCTGTCCCTCACCTGCACTGTCTCTGGTGGCTCCATCAGCAGTAGAAGT<br>TACTACTGGGGCTGGATCCGCCAGCCCCCAGGGAAGGGGCTGGAGTGGAT<br>TGGGAGTATCTATTATAGTGGGTTCACCTACTACCAACCGTCCCTCAAGA<br>GTCGAGTCACCATATCCGTTGACACGTCCAAGAACCAGTTCTCCCTGAAG<br>CTGAGCTCTGTGACCGCCGCAGACACGGCTGTGTATTATTGTGCGACAGG<br>GGGGCCCTACGGTGACTACGCCCACTGGTTCGAACCCTGGGGCCAGGGAA<br>CCCTGGTCACCGTCTCCTCAGCTAGCACCAAGGGCCCATCGGTCTTCCCC<br>CTGGCACCCTCCTCCAAGAGCACCTCTGGGGGCACAGCGGCCCTGGGCTG<br>CCTGGTCAAGGACTACTTCCCCGAACCGGTGACGGTGTCGTGGAACTCAG<br>GCGCCCTGACCAGCGGCGTGCACACCTTCCCGGCTGTCCTACAGTCCTCA<br>GGACTCTACTCCCTCAGCAGCGTGGTGACCGTGCCCTCCAGCAGCTTGGG<br>CACCCAGACCTACATCTGCAACGTGAATCACAAGCCCAGCAACACCAAGG<br>TGGACAAGAGAGTTGAGCCCAAATCTTGTGACAAAACTCACACATGCCCA<br>CCGTGCCCAGCACCTGAAGCCAAGGGGCCCCGTCAGTCTTCCTCTTCCC<br>CCCAAAACCCAAGGACACCCTCATGATCTCCCGGACCCCTGAGGTCACAT<br>GCGTGGTGGTGGACGTGAGCCACGAAGACCCTGAGGTCAAGTTCAACTGG<br>TACGTGGACGGCGTGGAGGTGCATAATGCCAAGACAAAGCCGCGGGAGGA<br>GCAGTACAACAGCACGTACCGTGTGGTCAGCGTCCTCACCGTCCTGCACC<br>AGGACTGGCTGAATGGCAAGGAGTACAAGTGCAAGGTCTCCAACAAAGCC<br>CTCCCAGCCCCCATCGAGAAAACCATCTCCAAAGCCAAAGGGCAGCCCCG<br>AGAACCACAGGTGTACACCCTGCCCCCATCCCGGGAGGAGATGACCAAGA<br>ACCAGGTCAGCCTGACCTGCCTGGTCAAAGGCTTCTATCCCAGCGACATC<br>GCCGTGGAGTGGGAGAGCAATGGGCAGCCGGAGAACAACTACAAGACCAC<br>GCCTCCCGTGCTGGACTCCGACGGCTCCTTCTTCCTCTATAGCAAGCTCA<br>CCGTGGACAAGAGCAGGTGGCAGCAGGGGAACGTCTTCTCATGCTCCGTG<br>ATGCATGAGGCTCTGCACAACCACTACACGCAGAAGAGCCTCTCCCTGTC<br>CCCGGGTTGA |
| 296 | 13A3 (N60Q, D101E) (TIM3.18) | IgG1.3f HC (T168C) with signal sequence (underline) | <u>ATGAGGGCTTGGATCTTCTTTCTGCTCTGCCTGGCCGGGAGAGCGCCGC<br>A</u>CAGCTGCAGCTGCAGGAGTCGGGCCCAGGACTGGTGAAGCCTTCGGAGA<br>CCCTGTCCCTCACCTGCACTGTCTCTGGTGGCTCCATCAGCAGTAGAAGT<br>TACTACTGGGGCTGGATTCGCCAGCCCCCAGGGAAGGGGCTGGAGTGGAT<br>TGGGAGTATCTATTATAGTGGGTTCACCTACTACCAACCGTCCCTCAAGA<br>GTCGAGTCACCATATCCGTTGACACGTCCAAGAACCAGTTCTCCCTGAAG<br>CTGAGCTCTGTGACCGCCGCAGACACGGCTGTGTATTATTGTGCGACAGG<br>GGGGCCCTACGGTGACTACGCCCACTGGTTCGAACCCTGGGGCCAGGGAA<br>CCCTGGTCACCGTCTCCTCAGCTAGCACCAAGGGCCCATCGGTCTTCCCC<br>CTGGCACCCTCCTCCAAGAGCACCTCTGGGGGCACAGCGGCCCTGGGCTG<br>CCTGGTCAAGGACTACTTCCCCGAACCGGTGACGGTGTCGTGGAACTCAG<br>GCGCCCTGACCAGCGGCGTGCACACCTTCCCGGCTGTCCTACAGTCCTCA<br>GGACTCTACTCCCTCAGCAGCGTGGTGACCGTGCCCTCCAGCAGCTTGGG<br>CACCCAGACCTACATCTGCAACGTGAATCACAAGCCCAGCAACACCAAGG<br>TGGACAAGAGAGTTGAGCCCAAATCTTGTGACAAAACTCACACATGCCCA<br>CCGTGCCCAGCACCTGAAGCCAAGGGGCCCCGTCAGTCTTCCTCTTCCC<br>CCCAAAACCCAAGGACACCCTCATGATCTCCCGGACCCCTGAGGTCACAT<br>GCGTGGTGGTGGACGTGAGCCACGAAGACCCTGAGGTCAAGTTCAACTGG<br>TACGTGGACGGCGTGGAGGTGCATAATGCCAAGACAAAGCCGCGGGAGGA<br>GCAGTACAACAGCACGTACCGTGTGGTCAGCGTCCTCACCGTCCTGCACC<br>AGGACTGGCTGAATGGCAAGGAGTACAAGTGCAAGGTCTCCAACAAAGCC<br>CTCCCAGCCCCCATCGAGAAAACCATCTCCAAAGCCAAAGGGCAGCCCCG<br>AGAACCACAGGTGTACACCCTGCCCCCATCCCGGGAGGAGATGACCAAGA<br>ACCAGGTCAGCCTGACCTGCCTGGTCAAAGGCTTCTATCCCAGCGACATC<br>GCCGTGGAGTGGGAGAGCAATGGGCAGCCGGAGAACAACTACAAGACCAC<br>GCCTCCCGTGCTGGACTCCGACGGCTCCTTCTTCCTCTATAGCAAGCTCA<br>CCGTGGACAAGAGCAGGTGGCAGCAGGGGAACGTCTTCTCATGCTCCGTG<br>ATGCATGAGGCTCTGCACAACCACTACACGCAGAAGAGCCTCTCCCTGTC<br>CCCGGGTAAATGA |
| 297 | 13A3 (N60Q, D101E) (TIM3.18) | IgG1.3f HC (T168C) (no C-terminal K) with signal sequence (underline) | <u>ATGAGGGCTTGGATCTTCTTTCTGCTCTGCCTGGCCGGGAGAGCGCTCGC<br>A</u>CAGCTGCAGCTGCAGGAGTCGGGCCCAGGACTGGTGAAGCCTTCGGAGA<br>CCCTGTCCCTCACCTGCACTGTCTCTGGTGGCTCCATCAGCAGTAGAAGT<br>TACTACTGGGGCTGGATTCGCCAGCCCCCAGGGAAGGGGCTGGAGTGGAT<br>TGGGAGTATCTATTATAGTGGGTTCACCTACTACCAACCGTCCCTCAAGA<br>GTCGAGTCACCATATCCGTTGACACGTCCAAGAACCAGTTCTCCCTGAAG<br>CTGAGCTCTGTGACCGCCGCAGACACGGCTGTGTATTATTGTGCGACAGG<br>GGGGCCCTACGGTGACTACGCCCACTGGTTCGAACCCTGGGGCCAGGGAA<br>CCCTGGTCACCGTCTCCTCAGCTAGCACCAAGGGCCCATCGGTCTTCCCC<br>CTGGCACCCTCCTCCAAGAGCACCTCTGGGGGCACAGCGGCCCTGGGCTG<br>CCTGGTCAAGGACTACTTCCCCGAACCGGTGACGGTGTCGTGGAACTCAG<br>GCGCCCTGACCAGCGGCGTGCACACCTTCCCGGCTGTCCTACAGTCCTCA<br>GGACTCTACTCCCTCAGCAGCGTGGTGACCGTGCCCTCCAGCAGCTTGGG<br>CACCCAGACCTACATCTGCAACGTGAATCACAAGCCCAGCAACACCAAGG<br>TGGACAAGAGAGTTGAGCCCAAATCTTGTGACAAAACTCACACATGCCCA<br>CCGTGCCCAGCACCTGAAGCCAAGGGGCCCCGTCAGTCTTCCTCTTCCC<br>CCCAAAACCCAAGGACACCCTCATGATCTCCCGGACCCCTGAGGTCACAT |

TABLE 8-continued

| SEQ ID | Antibody | Description | Sequences |
|---|---|---|---|
| | | | GCGTGGTGGTGGACGTGAGCCACGAAGACCCTGAGGTCAAGTTCAACTGG<br>TACGTGGACGGCGTGGAGGTGCATAATGCCAAGACAAAGCCGCGGGAGGA<br>GCAGTACAACAGCACGTACCGTGTGGTCAGCGTCCTCACCGTCCTGCACC<br>AGGACTGGCTGAATGGCAAGGAGTACAAGTGCAAGGTCTCCAACAAAGCC<br>CTCCCAGCCCCCATCGAGAAAACCATCTCCAAAGCCAAAGGGCAGCCCCG<br>AGAACCACAGGTGTACACCCTGCCCCCATCCCGGGAGGAGATGACCAAGA<br>ACCAGGTCAGCCTGACCTGCCTGGTCAAAGGCTTCTATCCCAGCGACATC<br>GCCGTGGAGTGGGAGAGCAATGGGCAGCCGGAGAACAACTACAAGACCAC<br>GCCTCCCGTGCTGGACTCCGACGGCTCCTTCTTCCTCTATAGCAAGCTCA<br>CCGTGGACAAGAGCAGGTGGCAGCAGGGGAACGTCTTCTCATGCTCCGTG<br>ATGCATGAGGCTCTGCACAACCACTACACGCAGAAGAGCCTCTCCCTGTC<br>CCCGGGTTGA |
| 298 | 13A3 (N60Q, D101E) (TIM3.18) | LC with signal sequence (underline) | <u>MRAWIFFLLCLAGRALAE</u>IVLTQSPGTLSLSPGERATLSCRASQSVSSSY<br>LAWYQQKPGQAPRLLITGASSRATGIPDRFSGSGSGTDFTLTISRLEPED<br>FAVYYCQQYGSSPITFGQGTRLEIKRTVAAPSVFIFPPSDEQLKSGTASV<br>VCLLNNFYPREAKVQWKVDNALQSGNSQESVTEQDSKDSTYSLSSTLTLS<br>KADYEKHEVYACEVTHQGLSSPVTKSFNRGEC* |
| 299 | 13A3 (N60Q, D101E) (TIM3.18) | LC with signal sequence (underline) | <u>ATGAGGGCTTGGATCTTCTTTCTGCTCTGCCTGGCCGGGCGCGCCTTGGC</u><br><u>CGAAATT</u>GTGTTGACGCAGTCTCCAGGCACCCTGTCTTTGTCTCCAGGGG<br>AAAGAGCCACCCTCTCCTGCAGGGCCAGTCAGAGTGTTAGCAGCAGCTAC<br>TTAGCCTGGTACCAGCAGAAACCTGGCCAGGCTCCCAGGCTCCTCATCTA<br>TGGTGCATCCAGCAGGGCCACTGGCATCCCAGACAGGTTCAGTGGCAGTG<br>GGTCTGGGACAGACTTCACTCTCACCATCAGCAGACTGGAGCCTGAAGAT<br>TTTGCAGTGTATTACTGTCAGCAGTATGGTAGCTCACCGATCACCTTCGG<br>CCAAGGGACACGACTGGAGATTAAACGTACGGTGGCTGCACCATCTGTCT<br>TCATCTTCCCGCCATCTGATGAGCAGTTGAAATCTGGAACTGCCTCTGTT<br>GTGTGCCTGCTGAATAACTTCTATCCCAGAGAGGCCAAAGTACAGTGGAA<br>GGTGGATAACGCCCTCCAATCGGGTAACTCCCAGGAGAGTGTCACAGAGC<br>AGGACAGCAAGGACAGCACCTACAGCCTCAGCAGCACCCTGACGCTGAGC<br>AAAGCAGACTACGAGAAACACAAAGTCTACGCCTGCGAAGTCACCCATCA<br>GGGCCTGAGCTCGCCCGTCACAAAGAGCTTCAACAGGGGAGAGTGTTAG |

This PCT application claims the priority benefit of U.S. Provisional Application No. 62/551,137, filed Aug. 28, 2017, which is incorporated herein by reference in its entirety.

SEQUENCE LISTING (299 sequences)

SEQ ID NO: 1 - protein, 123 aa, Artificial Sequence
  VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSS

SEQ ID NO: 2 - protein, 117 aa, Artificial Sequence
  VH
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSS

SEQ ID NO: 3 - protein, 117 aa, Artificial Sequence
  VH
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSS

SEQ ID NO: 4 - protein, 123 aa, Artificial Sequence
  VH
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSS

SEQ ID NO: 5 - protein, 123 aa, Artificial Sequence
  VH
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSS

SEQ ID NO: 6 - protein, 124 aa, Artificial Sequence
  VH
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSS

SEQ ID NO: 7 - protein, 123 aa, Artificial Sequence
  VH
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSS

SEQ ID NO: 8 - protein, 123 aa, Artificial Sequence
  VH
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSS

SEQ ID NO: 9 - protein, 123 aa, Artificial Sequence
  VH
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSS

SEQ ID NO: 10 - protein, 123 aa, Artificial Sequence
  VH
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSS

SEQ ID NO: 11 - protein, 123 aa, Artificial Sequence
  VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSS

SEQ ID NO: 12 - protein, 123 aa, Artificial Sequence
  VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSS

SEQ ID NO: 13 - protein, 123 aa, Artificial Sequence
  VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSS

SEQ ID NO: 14 - protein, 123 aa, Artificial Sequence
  VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSS

SEQ ID NO: 15 - protein, 123 aa, Artificial Sequence
  VH
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSS

SEQ ID NO: 16 - protein, 117 aa, Artificial Sequence
  VH
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSS

SEQ ID NO: 17 - protein, 123 aa, Artificial Sequence
  VH
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSS

SEQ ID NO: 18 - protein, 123 aa, Artificial Sequence
  VH
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSS

SEQ ID NO: 19 - protein, 108 aa, Artificial Sequence
  VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIK

SEQ ID NO: 20 - protein, 108 aa, Artificial Sequence
  VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 21 - protein, 107 aa, Artificial Sequence
  VL
AIQLTQSPSSLSASVGDRVTITCRASQGISSALAWYQQKPGKAPKLLIYDASSLESGVPSRFSGSGSGTDFTLTISSLQPEDFATYYCQQFNSYPRTFGQGTKVEIK

SEQ ID NO: 22 - protein, 107 aa, Artificial Sequence
  VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIK

SEQ ID NO: 23 - protein, 7 aa, Artificial Sequence
  CDR1 (VH)
SRSYYWG

SEQ ID NO: 24 - protein, 5 aa, Artificial Sequence
  CDR1 (VH)
RHYWN

SEQ ID NO: 25 - protein, 5 aa, Artificial Sequence
  CDR1 (VH)
RYYWS

SEQ ID NO: 26 - protein, 5 aa, Artificial Sequence
  CDR1 (VH)
SYYMH

SEQ ID NO: 27 - protein, 5 aa, Artificial Sequence
  CDR1 (VH)
DYYMS

SEQ ID NO: 28 - protein, 16 aa, Artificial Sequence
  CDR2 (VH)
SIYYSGFTYYNPSLKS

SEQ ID NO: 29 - protein, 16 aa, Artificial Sequence
  CDR2 (VH)
YIHYSGSTNYNSSLKS

SEQ ID NO: 30 - protein, 16 aa, Artificial Sequence
  CDR2 (VH)
YIHYTGSTNYNPSLKS

SEQ ID NO: 31 - protein, 17 aa, Artificial Sequence
  CDR2 (VH)
IINPRGDSIIYAQKFQG

SEQ ID NO: 32 - protein, 17 aa, Artificial Sequence
  CDR2 (VH)
FISGGGSTIYYADSVKG

SEQ ID NO: 33 - protein, 17 aa, Artificial Sequence
  CDR2 (VH)
FISTSGSIIYYADSVKG

SEQ ID NO: 34 - protein, 17 aa, Artificial Sequence
  CDR2 (VH)
FISSSGSIIYYADSVKG

SEQ ID NO: 35 - protein, 16 aa, Artificial Sequence
  CDR2 (VH)
SIYYSGFTYYQPSLKS

SEQ ID NO: 36 - protein, 16 aa, Artificial Sequence
  CDR2 (VH)
SIYYSGFTYYSPSLKS

SEQ ID NO: 37 - protein, 16 aa, Artificial Sequence
  CDR2 (VH)
SIYYSGFTYYAPSLKS

SEQ ID NO: 38 - protein, 16 aa, Artificial Sequence
  CDR2 (VH)
YIHYSGSTNYNPSLKS

SEQ ID NO: 39 - protein, 13 aa, Artificial Sequence
  CDR3 (VH)
GGPYGDYAHWFDP

SEQ ID NO: 40 - protein, 9 aa, Artificial Sequence
  CDR3 (VH)
DTGYYGMDI

SEQ ID NO: 41 - protein, 9 aa, Artificial Sequence
  CDR3 (VH)
DTGYYGMDV

SEQ ID NO: 42 - protein, 14 aa, Artificial Sequence
  CDR3 (VH)
DFYGSGNYYYGMDV

SEQ ID NO: 43 - protein, 14 aa, Artificial Sequence
  CDR3 (VH)
DGYSSGWYYYGMDV

SEQ ID NO: 44 - protein, 15 aa, Artificial Sequence
  CDR3 (VH)
EGYSSSWSYYYGMDV

SEQ ID NO: 45 - protein, 14 aa, Artificial Sequence
  CDR3 (VH)
DGYSSGWEYYGMDV

SEQ ID NO: 46 - protein, 13 aa, Artificial Sequence
  CDR3 (VH)
GGPYGDYAHWFEP

SEQ ID NO: 47 - protein, 13 aa, Artificial Sequence
  CDR3 (VH)
GGPYGDYAHWFDV

SEQ ID NO: 48 - protein, 13 aa, Artificial Sequence
  CDR3 (VH)
GGPYGDYAHWFDY

SEQ ID NO: 49 - protein, 13 aa, Artificial Sequence
  CDR3 (VH)
GGPYGDYAHWFDL

SEQ ID NO: 50 - protein, 12 aa, Artificial Sequence
  CDR1 (VL)
RASQSVSSSYLA

SEQ ID NO: 51 - protein, 11 aa, Artificial Sequence
  CDR1 (VL)
RASQGISSALA

SEQ ID NO: 52 - protein, 7 aa, Artificial Sequence
  CDR2 (VL)
GASSRAT

SEQ ID NO: 53 - protein, 7 aa, Artificial Sequence
  CDR2 (VL)
DASSLES

SEQ ID NO: 54 - protein, 9 aa, Artificial Sequence
  CDR3 (VL)
QQYGSSPIT

SEQ ID NO: 55 - protein, 9 aa, Artificial Sequence
  CDR3 (VL)
QQYGSSPLT

SEQ ID NO: 56 - protein, 9 aa, Artificial Sequence
  CDR3 (VL)
QQFNSYPRT

SEQ ID NO: 57 - protein, 8 aa, Artificial Sequence
  CDR3 (VL)
QQYGSSLT

SEQ ID NO: 58 - protein, 330 aa, Homo sapiens [sequence omitted]

SEQ ID NO: 59 - protein, 330 aa, Artificial Sequence
  human IgG1 (allotypic variant)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 330 aa, Artificial Sequence
  IgG1.3 constant domain (used in anti-TIM3 antibodies)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - skipped

SEQ ID NO: 63 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 64 - protein, 107 aa, Artificial Sequence [sequence omitted]

SEQ ID NO: 65 - protein, 5 aa, Artificial Sequence
  LSPGK (C-terminal end of heavy chain)
LSPGK

SEQ ID NO: 66 - protein, 4 aa, Artificial Sequence
  LSPG (C-terminal end of heavy chain)
LSPG

SEQ ID NO: 67 - protein, 3 aa, Artificial Sequence
  LSP (C-terminal end of heavy chain)
LSP

SEQ ID NO: 68 - protein, 453 aa, Artificial Sequence
  IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 447 aa, Artificial Sequence
  IgG1.1f HC
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 447 aa, Artificial Sequence
  IgG1.1f HC
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 453 aa, Artificial Sequence
  IgG1.1f HC
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 453 aa, Artificial Sequence
  IgG1.1f HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 454 aa, Artificial Sequence
  IgG1.1f HC
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 453 aa, Artificial Sequence
  IgG1.1f HC
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 76 - protein, 446 aa, Artificial Sequence
  IgG1.1f HC (no C-terminal K)
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 77 - protein, 446 aa, Artificial Sequence
  IgG1.1f HC (no C-terminal K)
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 78 - protein, 452 aa, Artificial Sequence
  IgG1.1f HC (no C-terminal K)
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 79 - protein, 452 aa, Artificial Sequence
  IgG1.1f HC (no C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 80 - protein, 453 aa, Artificial Sequence
  IgG1.1f HC (no C-terminal K)
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 81 - protein, 452 aa, Artificial Sequence
  IgG1.1f HC (no C-terminal K)
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 82 - protein, 453 aa, Artificial Sequence
  IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 447 aa, Artificial Sequence
  IgG1.3f HC
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 447 aa, Artificial Sequence
  IgG1.3f HC
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 453 aa, Artificial Sequence
  IgG1.3f HC
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 453 aa, Artificial Sequence
  IgG1.3f HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 454 aa, Artificial Sequence
  IgG1.3f HC
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 453 aa, Artificial Sequence
  IgG1.3f HC
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 90 - protein, 446 aa, Artificial Sequence
  IgG1.3f HC (no C-terminal K)
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 91 - protein, 446 aa, Artificial Sequence
  IgG1.3f HC (no C-terminal K)
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 92 - protein, 452 aa, Artificial Sequence
  IgG1.3f HC (no C-terminal K)
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 93 - protein, 452 aa, Artificial Sequence
  IgG1.3f HC (no C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 94 - protein, 453 aa, Artificial Sequence
  IgG1.3f HC (no C-terminal K)
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 95 - protein, 452 aa, Artificial Sequence
  IgG1.3f HC (no C-terminal K)
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 96 - protein, 453 aa, Artificial Sequence
  IgG1.1f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 453 aa, Artificial Sequence
  IgG1.1f HC
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 453 aa, Artificial Sequence
  IgG1.1f HC
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 453 aa, Artificial Sequence
  IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 453 aa, Artificial Sequence
  IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 453 aa, Artificial Sequence
  IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 453 aa, Artificial Sequence
  IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 453 aa, Artificial Sequence
  IgG1.1f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 447 aa, Artificial Sequence
  IgG1.1f HC
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 453 aa, Artificial Sequence
  IgG1.1f HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 107 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 108 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 109 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 110 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 111 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 112 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 113 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 114 - protein, 446 aa, Artificial Sequence
  IgG1.1f HC (no C-terminal K)
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 115 - protein, 452 aa, Artificial Sequence
  IgG1.1f HC (no C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 116 - protein, 453 aa, Artificial Sequence
  IgG1.3f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 453 aa, Artificial Sequence
  IgG1.3f HC
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 453 aa, Artificial Sequence
  IgG1.3f HC
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 453 aa, Artificial Sequence
  IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 453 aa, Artificial Sequence
  IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 453 aa, Artificial Sequence
  IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 453 aa, Artificial Sequence
  IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 453 aa, Artificial Sequence
  IgG1.3f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 447 aa, Artificial Sequence
  IgG1.3f HC
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 453 aa, Artificial Sequence
  IgG1.3f HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 127 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 128 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 129 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 130 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 131 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 132 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 133 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 134 - protein, 446 aa, Artificial Sequence
  IgG1.3f HC (no C-terminal K)
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 135 - protein, 452 aa, Artificial Sequence
  IgG1.3f HC (no C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 136 - protein, 450 aa, Artificial Sequence
  hIgG4 HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 137 - protein, 449 aa, Artificial Sequence
  hIgG4 HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 138 - protein, 450 aa, Artificial Sequence
  IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 139 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 140 - protein, 450 aa, Artificial Sequence
  IgG4P HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 141 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 142 - protein, 450 aa, Artificial Sequence
  IgG4P HC
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 143 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 144 - protein, 450 aa, Artificial Sequence
  IgG4P HC
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 145 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 146 - protein, 450 aa, Artificial Sequence
  IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 147 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 148 - protein, 450 aa, Artificial Sequence
  IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 149 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 150 - protein, 450 aa, Artificial Sequence
  IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 151 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 152 - protein, 450 aa, Artificial Sequence
  IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 153 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 154 - protein, 450 aa, Artificial Sequence
  IgG4P HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 155 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 156 - protein, 447 aa, Artificial Sequence
  IgG1za HC
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 446 aa, Artificial Sequence
  IgG1za HC (without C-terminal K)
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 158 - protein, 444 aa, Artificial Sequence
  IgG4P HC
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 159 - protein, 443 aa, Artificial Sequence
  IgG4P HC (without C-terminal K)
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 160 - protein, 444 aa, Artificial Sequence
  IgG4P HC
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 161 - protein, 443 aa, Artificial Sequence
  IgG4P HC (without C-terminal K)
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 162 - protein, 447 aa, Artificial Sequence
  IgG1za HC
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 446 aa, Artificial Sequence
  IgG1za HC (without C-terminal K)
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 164 - protein, 367 aa, Artificial Sequence
  IgG4P HC
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 165 - protein, 366 aa, Artificial Sequence
  IgG4P HC (without C-terminal K)
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 166 - protein, 453 aa, Artificial Sequence
  IgG1za HC
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 452 aa, Artificial Sequence
  IgG1za HC (without C-terminal K)
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 168 - protein, 450 aa, Artificial Sequence
  IgG4P HC
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 169 - protein, 449 aa, Artificial Sequence
  IgG4P HC (without C-terminal K)
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 170 - protein, 453 aa, Artificial Sequence
  IgG1za HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 452 aa, Artificial Sequence
  IgG1za HC (without C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 172 - protein, 450 aa, Artificial Sequence
  IgG4P HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 173 - protein, 449 aa, Artificial Sequence
  IgG4P HC (without C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 174 - protein, 450 aa, Artificial Sequence
  IgG4P HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 175 - protein, 449 aa, Artificial Sequence
  IgG4P HC (without C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 176 - protein, 454 aa, Artificial Sequence
  IgG1za HC
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 453 aa, Artificial Sequence
  IgG1za HC (without C-terminal K)
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 178 - protein, 451 aa, Artificial Sequence
  IgG4P HC
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 179 - protein, 450 aa, Artificial Sequence
  IgG4P HC (without C-terminal K)
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 180 - protein, 450 aa, Artificial Sequence
  IgG4 HC
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 181 - protein, 449 aa, Artificial Sequence
  IgG4 HC (without C-terminal K)
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 182 - protein, 450 aa, Artificial Sequence
  IgG4P HC
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 183 - protein, 449 aa, Artificial Sequence
  IgG4P HC (without C-terminal K)
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 184 - protein, 453 aa, Artificial Sequence
  IgG1.1f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 452 aa, Artificial Sequence
  IgG1.1f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 186 - protein, 453 aa, Artificial Sequence
  IgG1.3f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 452 aa, Artificial Sequence
  IgG1.3f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 188 - protein, 450 aa, Artificial Sequence
  IgG4P HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 189 - protein, 449 aa, Artificial Sequence
  IgG4P HC (without C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 190 - protein, 215 aa, Artificial Sequence
  LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - protein, 215 aa, Artificial Sequence
  LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 192 - protein, 214 aa, Artificial Sequence
  LC
AIQLTQSPSSLSASVGDRVTITCRASQGISSALAWYQQKPGKAPKLLIYDASSLESGVPSRFSGSGSGTDFTLTISSLQPEDFATYYCQQFNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 193 - protein, 214 aa, Artificial Sequence
  LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 194 - protein, 300 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAM

SEQ ID NO: 195 - protein, 142 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPGEWTFACHLYE

SEQ ID NO: 196 - DNA, 2448 bp, Homo sapiens
agaacacttacaggatgtgtgtagtgtggcatgacagagaactttggtttcctttaatgtgactgtagacctggcagtgttactataagaatcactggcaatcagacacccgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgttaaaaaaaaaaaaaaaaaa

SEQ ID NO: 197 - DNA, 1012 bp, Homo sapiens
actgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccaggtgagtggacatttgcatgccatctttatgaataagatttatctgtggatcatattaaaggtactgattgttctcatctctgacttccctaattatagccctggaggagggccactaagacctaaagtttaacaggccccattggtgatgctcagtgatatttaacaccttctctctgttttaaaactcatgggtgtgcctgggcgtggtggctcgcgcctctggtcccagcactttgggaggctgaggccggtggatcatgaggtcaggaattcgagaccagcctggccaacatggtaaaaccttgtctccactaaaaatacaaaaaattagccaggcatggttacgggagcctgtaattctagctacttggggggctgaagcaggagaatcacttgaacctggaagtcggaggttgcggtaagccaagatctcgccattgtactccagcctggctgacaagagtgaaactctgtcccaaaaaaaaaaaaaaaaaaaaaaaaaaaaaa

SEQ ID NO: 198 - protein, 181 aa, Homo sapiens
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 199 - protein, 294 aa, Macaca fascicularis
MFSHLPFDCVLLLLLLLLTRSSEVEYIAEVGQNAYLPCSYTPAPPGNLVPVCWGKGACPVFDCSNVVLRTENRDVNDRTSGRYWLKGDFHKGDVSLTIENVTLADSGVYCCRIQIPGIMNDEKHNLKLVVIKPAKVTPAPTLQRDLTSAFPRMLTTGEHGPAETQTPGSLPDVNLTQIFTLTNELRDSGATIRTAIYIAAGISAGLALALIFGALIFKWYSHSKEKTQNLSLISLANIPPSGLANAVAEGIRSEENIYTIEEDVYEVEEPNEYYCYVSSGQQPSQPLGCRFAMP

SEQ ID NO: 200 - protein, 7 aa, Homo sapiens
CPVFECG

SEQ ID NO: 201 - protein, 12 aa, Homo sapiens
WTSRYWLNGDFR

SEQ ID NO: 202 - protein, 10 aa, Homo sapiens
RIQIPGIMND

SEQ ID NO: 203 - protein, 99 aa, Homo sapiens
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMND

SEQ ID NO: 204 - protein, 14 aa, Homo sapiens
VPVCWGKGACPVFE

SEQ ID NO: 205 - protein, 17 aa, Homo sapiens
RIQIPGIMNDEKFNLKL

SEQ ID NO: 206 - protein, 23 aa, Homo sapiens
YTPAAPGNLVPVCWGKGACPVFE

SEQ ID NO: 207 - protein, 12 aa, Homo sapiens
VVLRTDERDVNY

SEQ ID NO: 208 - protein, 18 aa, Homo sapiens
WTSRYWLNGDFRKGDVSL

SEQ ID NO: 209 - protein, 18 aa, Homo sapiens
CRIQIPGIMNDEKFNLKL

SEQ ID NO: 210 - protein, 9 aa, Homo sapiens
NDEKFNLKL

SEQ ID NO: 211 - protein, 7 aa, Artificial Sequence
  X1X2X3X4YX5X6 (VH CDR1 degenerate)
  misc_feature (1)..(4): Xaa can be any naturally occurring amino acid
  misc_feature (6)..(7): Xaa can be any naturally occurring amino acid
XXXXYXX

SEQ ID NO: 212 - protein, 17 aa, Artificial Sequence
  X1IX2X3X4GX5X6X7X8YX9X10X11X12X13X14 (VH CDR2 degenerate)
  misc_feature (1)..(1): Xaa can be any naturally occurring amino acid
  misc_feature (3)..(5): Xaa can be any naturally occurring amino acid
  misc_feature (7)..(10): Xaa can be any naturally occurring amino acid
  misc_feature (12)..(17): Xaa can be any naturally occurring amino acid
XIXXXGXXXXYXXXXXX

SEQ ID NO: 213 - protein, 20 aa, Artificial Sequence
  X1X2X3X4X5X6YGX7X8X9X10YGX11X12DX13X14X15X16X17X18 (VH CDR3 degenerate)
  misc_feature (1)..(10): Xaa can be any naturally occurring amino acid
  misc_feature (13)..(20): Xaa can be any naturally occurring amino acid
XXXXXXXXXXYGXXXXXXXX

SEQ ID NO: 214 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 215 - DNA, 1344 bp, artificial sequence
  IgG1.1f HC
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 216 - DNA, 1344 bp, artificial sequence
  IgG1.1f HC
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 217 - DNA, 1362 bp, artificial sequence
  IgG1.1f HC
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 218 - DNA, 1362 bp, artificial sequence
  IgG1.1f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 219 - DNA, 1365 bp, artificial sequence
  IgG1.1f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 220 - DNA, 1362 bp, artificial sequence
  IgG1.1f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 221 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 222 - DNA, 1341 bp, artificial sequence
  IgG1.1f HC (no C-terminal K)
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 223 - DNA, 1341 bp, artificial sequence
  IgG1.1f HC (no C-terminal K)
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 224 - DNA, 1359 bp, artificial sequence
  IgG1.1f HC (no C-terminal K)
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 225 - DNA, 1359 bp, artificial sequence
  IgG1.1f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 226 - DNA, 1362 bp, artificial sequence
  IgG1.1f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 227 - DNA, 1359 bp, artificial sequence
  IgG1.1f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 228 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 229 - DNA, 1343 bp, artificial sequence
  IgG1.3f HC
aggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 230 - DNA, 1344 bp, artificial sequence
  IgG1.3f HC
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 231 - DNA, 1362 bp, artificial sequence
  IgG1.3f HC
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 232 - DNA, 1362 bp, artificial sequence
  IgG1.3f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 233 - DNA, 1365 bp, artificial sequence
  IgG1.3f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 234 - DNA, 1362 bp, artificial sequence
  IgG1.3f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 235 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 236 - DNA, 1340 bp, artificial sequence
  IgG1.3f HC (no C-terminal K)
aggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 237 - DNA, 1341 bp, artificial sequence
  IgG1.3f HC (no C-terminal K)
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 238 - DNA, 1359 bp, artificial sequence
  IgG1.3f HC (no C-terminal K)
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 239 - DNA, 1359 bp, artificial sequence
  IgG1.3f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 240 - DNA, 1362 bp, artificial sequence
  IgG1.3f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 241 - DNA, 1359 bp, artificial sequence
  IgG1.3f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 242 - DNA, 648 bp, artificial sequence
  LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 243 - DNA, 648 bp, artificial sequence
  LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 244 - DNA, 648 bp, artificial sequence
  LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 245 - DNA, 645 bp, artificial sequence
  LC
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 246 - DNA, 645 bp, artificial sequence
  LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 247 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 248 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 249 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 250 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 251 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 252 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 253 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 254 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 255 - DNA, 1344 bp, artificial sequence
  IgG1.1f HC
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 256 - DNA, 1362 bp, artificial sequence
  IgG1.1f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 257 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 258 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 259 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 260 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 261 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 262 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 263 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 264 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 265 - DNA, 1341 bp, artificial sequence
  IgG1.1f HC (no C-terminal K)
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 266 - DNA, 1359 bp, artificial sequence
  IgG1.1f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 267 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 268 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 269 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 270 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 271 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 272 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 273 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 274 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 275 - DNA, 1344 bp, artificial sequence
  IgG1.3f HC
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 276 - DNA, 1362 bp, artificial sequence
  IgG1.3f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 277 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 278 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 279 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 280 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 281 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 282 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 283 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 284 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 285 - DNA, 1341 bp, artificial sequence
  IgG1.3f HC (no C-terminal K)
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 286 - DNA, 1359 bp, artificial sequence
  IgG1.3f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 287 - DNA, 1362 bp, artificial sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 288 - DNA, 1359 bp, artificial sequence
  IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 289 - DNA, 1362 bp, artificial sequence
  IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 290 - DNA, 1359 bp, artificial sequence
  IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 291 - DNA, 1359 bp, artificial sequence
  IgG1.3f (T168C) (no C-terminal K)
cagctgcagctgcaggagtcgggcccaggactggtgaagccttcggagaccctgtccctcacctgcactgtctctggtggctccatcagcagtagaagttactactggggctggattcgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 292 - protein, 470 aa, artificial sequence
  IgG1.3f HC with signal peptide
MRAWIFFLLCLAGRALAQLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 469 aa, artificial sequence
  IgG1.3f HC (no C-terminal K) with signal peptide
MRAWIFFLLCLAGRALAQLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 294 - DNA, 1413 bp, artificial sequence
  IgG1.3f HC with signal peptide
atgagggcttggatcttctttctgctctgcctggccgggagagcgctcgcacagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 295 - DNA, 1410 bp, artificial sequence
  IgG1.3f HC (no C-terminal K) with signal peptide
atgagggcttggatcttctttctgctctgcctggccgggagagcgctcgcacagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 296 - DNA, 1413 bp, artificial sequence
  IgG1.3f HC (T168C) with signal sequence
atgagggcttggatcttctttctgctctgcctggccgggagagcgctcgcacagctgcagctgcaggagtcgggcccaggactggtgaagccttcggagaccctgtccctcacctgcactgtctctggtggctccatcagcagtagaagttactactggggctggattcgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 297 - DNA, 1410 bp, artificial sequence
  IgG1.3f HC (T168C) (no C-terminal K) with signal sequence
atgagggcttggatcttctttctgctctgcctggccgggagagcgctcgcacagctgcagctgcaggagtcgggcccaggactggtgaagccttcggagaccctgtccctcacctgcactgtctctggtggctccatcagcagtagaagttactactggggctggattcgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 298 - protein, 232 aa, artificial sequence
  LC with signal sequence
MRAWIFFLLCLAGRALAEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - DNA, 699 bp, artificial sequence
  LC with signal sequence
atgagggcttggatcttctttctgctctgcctggccgggcgcgccttggccgaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

The invention claimed is:

1. A method of treating a cancer in a human subject, comprising administering (i) an antibody or antigen-binding portion thereof that specifically binds T-cell immunoglobulin and mucin-domain containing-3 (TIM-3) ("anti-TIM-3 antibody") and (ii) an antibody or an antigen-binding portion thereof that specifically binds a Programmed Death-1 receptor (PD-1) ("anti-PD-1 antibody") to the subject;
 wherein the subject has a serum titer of at least 2100 pg/ml soluble TIM-3; and
 wherein the anti-TIM-3_antibody comprises (i) a heavy chain variable region comprising CDR1, CDR2, and CDR3, and (ii) a light chain variable region comprising CDR1, CDR2, and CDR3, wherein
  (a) the heavy chain CDR1 comprises an amino acid sequence selected from the group consisting of SEQ ID NOs: 23-27;
  (b) the heavy chain CDR2 comprises an amino acid sequence selected from the group consisting of SEQ ID NOs: 28-38;
  (c) the heavy chain CDR3 comprises an amino acid sequence selected from the group consisting of SEQ ID NOs: 39-49;
  (d) the light chain CDR1 comprises an amino acid sequence selected from the group consisting of SEQ ID NOs: 50 and 51;
  (e) the light chain CDR2 comprises an amino acid sequence selected from the group consisting of SEQ ID NOs: 52 and 53; and
  (f) the light chain CDR3 comprises an amino acid sequence selected from the group consisting of SEQ ID NOs: 54-57.

2. A method of treating a cancer in a human subject, comprising (a) determining a serum titer of soluble T-cell immunoglobulin and mucin-domain containing-3 (TIM-3) in the subject, and (b) administering (i) an antibody or antigen-binding portion thereof that specifically binds TIM-3 ("anti-TIM-3 antibody") and (ii) an antibody or an antigen-binding portion thereof that specifically binds a Programmed Death-1 receptor (PD-1) ("anti-PD-1 antibody") to the subject if the serum titer of soluble TIM-3 in the subject is at least 2100 pg/ml;

wherein the anti-TIM-3_antibody comprises (i) a heavy chain variable region comprising CDR1, CDR2, and CDR3, and (ii) a light chain variable region comprising CDR1, CDR2, and CDR3, wherein
- (a) the heavy chain CDR1 comprises an amino acid sequence selected from the group consisting of SEQ ID NOs: 23-27;
- (b) the heavy chain CDR2 comprises an amino acid sequence selected from the group consisting of SEQ ID NOs: 28-38;
- (c) the heavy chain CDR3 comprises an amino acid sequence selected from the group consisting of SEQ ID NOs: 39-49;
- (d) the light chain CDR1 comprises an amino acid sequence selected from the group consisting of SEQ ID NOs: 50 and 51;
- (e) the light chain CDR2 comprises an amino acid sequence selected from the group consisting of SEQ ID NOs: 52 and 53; and
- (f) the light chain CDR3 comprises an amino acid sequence selected from the group consisting of SEQ ID NOs: 54-57.

3. The method of claim 1, wherein
- (a) the heavy chain CDR1 comprises the amino acid sequence set forth in SEQ ID NO: 23;
- (b) the heavy chain CDR2 comprises the amino acid sequence set forth in SEQ ID NO: 35;
- (c) the heavy chain CDR3 comprises the amino acid sequence set forth in SEQ ID NO: 46;
- (d) the light chain CDR1 comprises the amino acid sequence set forth in SEQ ID NO: 50;
- (e) the light chain CDR2 comprises the amino acid sequence set forth in SEQ ID NO: 52; and
- (f) the light chain CDR3 comprises the amino acid sequence set forth in SEQ ID NO: 54.

4. The method of claim 3, wherein the anti-TIM-3 antibody comprises a heavy chain comprising the amino acid sequence set forth in a sequence selected from SEQ ID NOs: 184-189, and a light chain comprising the amino acid sequence set forth in SEQ ID NO: 190.

5. The method of claim 1, wherein the anti-PD-1 antibody comprises nivolumab, pembrolizumab, MEDI0608, AMP-224, PDR001, BGB-A317, or any combination thereof.

6. The method of claim 1, wherein the anti-PD-1 antibody comprises nivolumab.

7. The method of claim 2, wherein
- (a) the heavy chain CDR1 comprises the amino acid sequence set forth in SEQ ID NO: 23;
- (b) the heavy chain CDR2 comprises the amino acid sequence set forth in SEQ ID NO: 35;
- (c) the heavy chain CDR3 comprises the amino acid sequence set forth in SEQ ID NO: 46;
- (d) the light chain CDR1 comprises the amino acid sequence set forth in SEQ ID NO: 50;
- (e) the light chain CDR2 comprises the amino acid sequence set forth in SEQ ID NO: 52; and
- (f) the light chain CDR3 comprises the amino acid sequence set forth in SEQ ID NO: 54.

8. The method of claim 7, wherein the anti-TIM-3 antibody comprises a heavy chain comprising the amino acid sequence set forth in a sequence selected from SEQ ID NOs: 184-189, and a light chain comprising the amino acid sequence set forth in SEQ ID NO: 190.

9. The method of claim 2, wherein the anti-PD-1 antibody comprises nivolumab, pembrolizumab, MEDI0608, AMP-224, PDR001, BGB-A317, or any combination thereof.

10. The method of claim 2, wherein the anti-PD-1 antibody comprises nivolumab.

11. The method of claim 1, wherein the subject is identified as having a serum titer in the subject is at least 2500 pg/ml soluble TIM-3.

12. The method of claim 2, wherein the serum titer in the subject is at least 2500 pg/ml soluble TIM-3.

13. The method of claim 3, wherein the anti-TIM-3 antibody comprises a heavy chain variable region comprising the amino acid sequence set forth in SEQ ID NO: 18 and a light chain variable region comprising the amino acid sequence set forth in SEQ ID NO: 19.

14. The method of claim 7, wherein the anti-TIM-3 antibody comprises a heavy chain variable region comprising the amino acid sequence set forth in SEQ ID NO: 18 and a light chain variable region comprising the amino acid sequence set forth in SEQ ID NO: 19.

15. The method of claim 1, wherein the cancer comprises a colon, kidney, or lung cancer.

16. The method of claim 6, wherein the cancer comprises a colon, kidney, or lung cancer.

* * * * *

UNITED STATES PATENT AND TRADEMARK OFFICE
CERTIFICATE OF CORRECTION

| | | |
|---|---|---|
| PATENT NO. | : 11,787,859 B2 | Page 1 of 1 |
| APPLICATION NO. | : 16/642511 | |
| DATED | : October 17, 2023 | |
| INVENTOR(S) | : Anke Klippel et al. | |

It is certified that error appears in the above-identified patent and that said Letters Patent is hereby corrected as shown below:

In the Claims

In Column 175, Claim 1, Line 61, delete "anti-TIM-3_antibody" and insert -- anti-TIM-3 antibody --, therefor.

In Column 177, Claim 2, Line 9, delete "anti-TIM-3_antibody" and insert -- anti-TIM-3 antibody --, therefor.

In Column 178, Claim 11, Lines 29-30, delete "subject is identified as having a".

Signed and Sealed this
Fifth Day of March, 2024

Katherine Kelly Vidal
*Director of the United States Patent and Trademark Office*